United States Patent
Schada Von Borzyskowski et al.

(10) Patent No.: US 12,378,570 B2
(45) Date of Patent: Aug. 5, 2025

(54) METHOD FOR THE PRODUCTION OF PLANTS WITH ALTERED PHOTORESPIRATION AND IMPROVED CO₂ FIXATION

(71) Applicants: Max-Planck-Gesellschaft zur Förderung der Wissenschaften e.V., Munich (DE); Heinrich-Heine-Universität Düsseldorf, Düsseldorf (DE)

(72) Inventors: Lennart Schada Von Borzyskowski, Marburg (DE); Tobias Jürgen Erb, Marburg (DE); Andreas Paul Michael Weber, Düsseldorf (DE); Marc-Sven Roll, Düsseldorf (DE)

(73) Assignees: Max-Planck-Gesellschaft zur Förderung der Wissenschaften e.V., Munich (DE); Heinrich-Heine-Universitat Dusseldorf, Dusseldorf (DE)

( * ) Notice: Subject to any disclaimer, the term of this patent is extended or adjusted under 35 U.S.C. 154(b) by 397 days.

(21) Appl. No.: 17/632,867

(22) PCT Filed: Aug. 5, 2020

(86) PCT No.: PCT/EP2020/072071
§ 371 (c)(1),
(2) Date: Feb. 4, 2022

(87) PCT Pub. No.: WO2021/023801
PCT Pub. Date: Feb. 11, 2021

(65) Prior Publication Data
US 2022/0315942 A1    Oct. 6, 2022

(30) Foreign Application Priority Data
Aug. 6, 2019   (EP) .................... 19190404

(51) Int. Cl.
*C12N 15/82* (2006.01)
*C12N 9/88* (2006.01)

(52) U.S. Cl.
CPC ........... *C12N 15/8269* (2013.01); *C12N 9/88* (2013.01); *C12N 15/8245* (2013.01)

(58) Field of Classification Search
None
See application file for complete search history.

(56) References Cited

U.S. PATENT DOCUMENTS

2006/0095981 A1   5/2006  Hain et al.
2012/0301947 A1   11/2012 Milo et al.

OTHER PUBLICATIONS

Nokhal and Schlegel. Int J Systematic Bacteriology.33(1): 26-37. (Year: 1983).*
Kornberg and Morris. "βHydroxyaspartate Pathway: A New Route for Biosyntheses from Glyoxylate," Nature. 197:456-457. (Year: 1963).*
Schwander. "The design and realization of synthetic pathways for the fixation of carbon dioxide in vitro." Dissertation. Philipps-Universität Marburg. (Year: 2017).*
Gibbs. "The enzymology of the B-hydroxyaspartate pathway". Dissertation. University of Leicester. (Year: 1966).*
GenBank Accession WP_011750151.1. (Year: 2018).*
Borzyskowski, et al. Nature. 575:500-504. (Year: 2019).*
International Search Report and Written Opinion for International Patent Application No. PCT/EP2020/072071 dated Sep. 22, 2020, 11 pages.
H. L Kornberg et al: "[beta]Hydroxyaspartate Pathway: A New Route for Biosyntheses from Glyoxylate", Nature, Feb. 2, 1963 (Feb. 2, 1963), pp. 456-457, XP055648258,EnglandDOI: 10.1038/197456a0Retrieved from the Internet:URL:https://www.nature.com/articles/197456 a0.pdfthe whole document.
Thomas Schwander: "The design and realization of synthetic pathways for the fixation of carbon dioxide in vitro", Jan. 1, 2018 (Jan. 1, 2018), XP055648354, Retrieved from the Internet: URL:http://archiv.ub.uni-marburg.de/diss/z2018/0066/pdf/dts.pdf p. 85, "6.1. Synthetic CO2 fixation cycles", especially last two sentences.
Bar-Even Arren et al: "Design and analysis of synthetic carbon fixation pathways", Proceedings of the National Academy of Sciences, National Academy of Sciences, vol. 107, No. 19, May 11, 2010 (May 11, 2010) , pp. 8889-8894, XP002638327, ISSN: 0027-8424, DOI: 10.1073/PNAS.0907176107 [retrieved on Apr. 21, 2010] abstract.

* cited by examiner

*Primary Examiner* — Mykola V. Kovalenko
*Assistant Examiner* — David R Byrnes
(74) *Attorney, Agent, or Firm* — Amin, Turocy & Watson, LLP

(57) ABSTRACT

The present invention relates to transgenic plants with altered photorespiration and improved CO₂ fixation as well as a method of producing said transgenic plants. Particularly, the transgenic plants show an improved growth rate, productivity and energy conversion efficiency. This method can be successfully applied to many agricultural crop plants with nutritional and medicinal uses.

11 Claims, 20 Drawing Sheets
Specification includes a Sequence Listing.

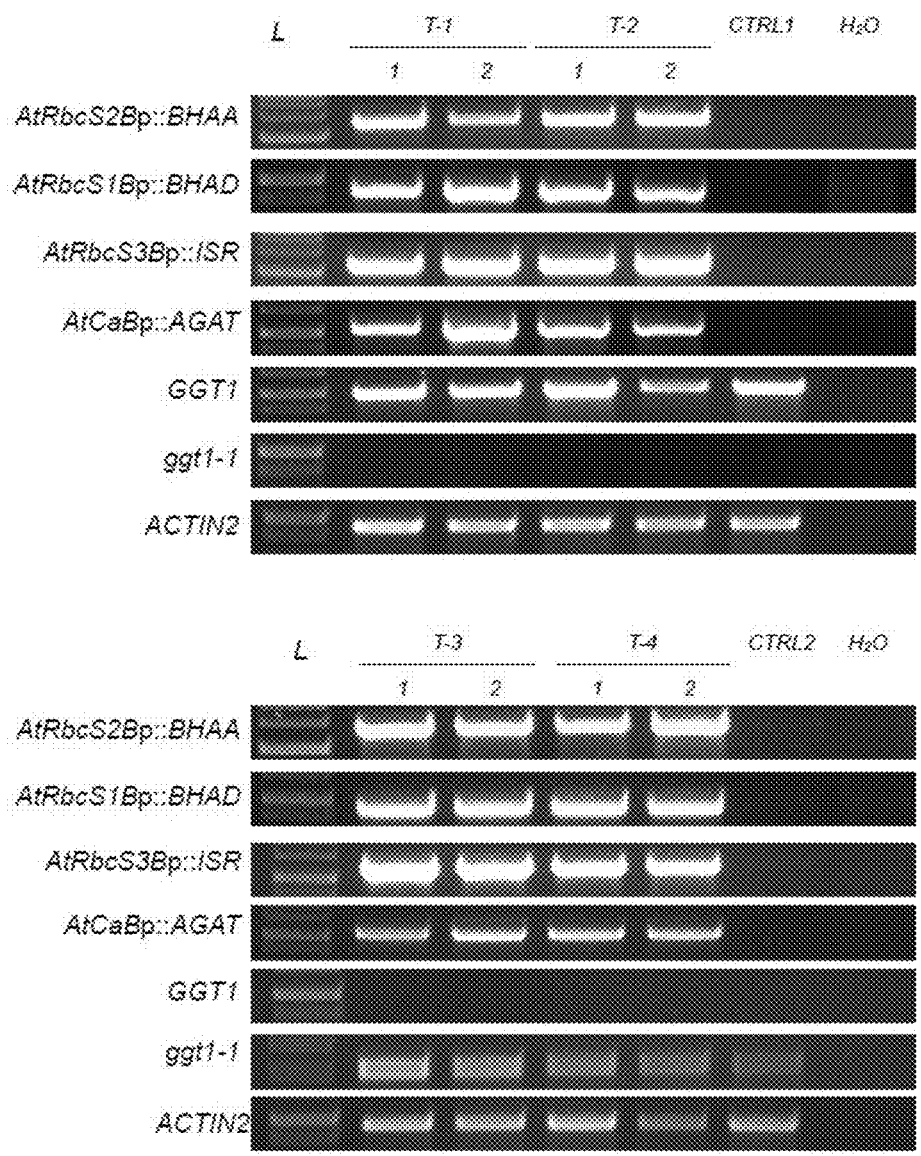
Figure 16 (*continue*)

Figure 17 (*continue*)
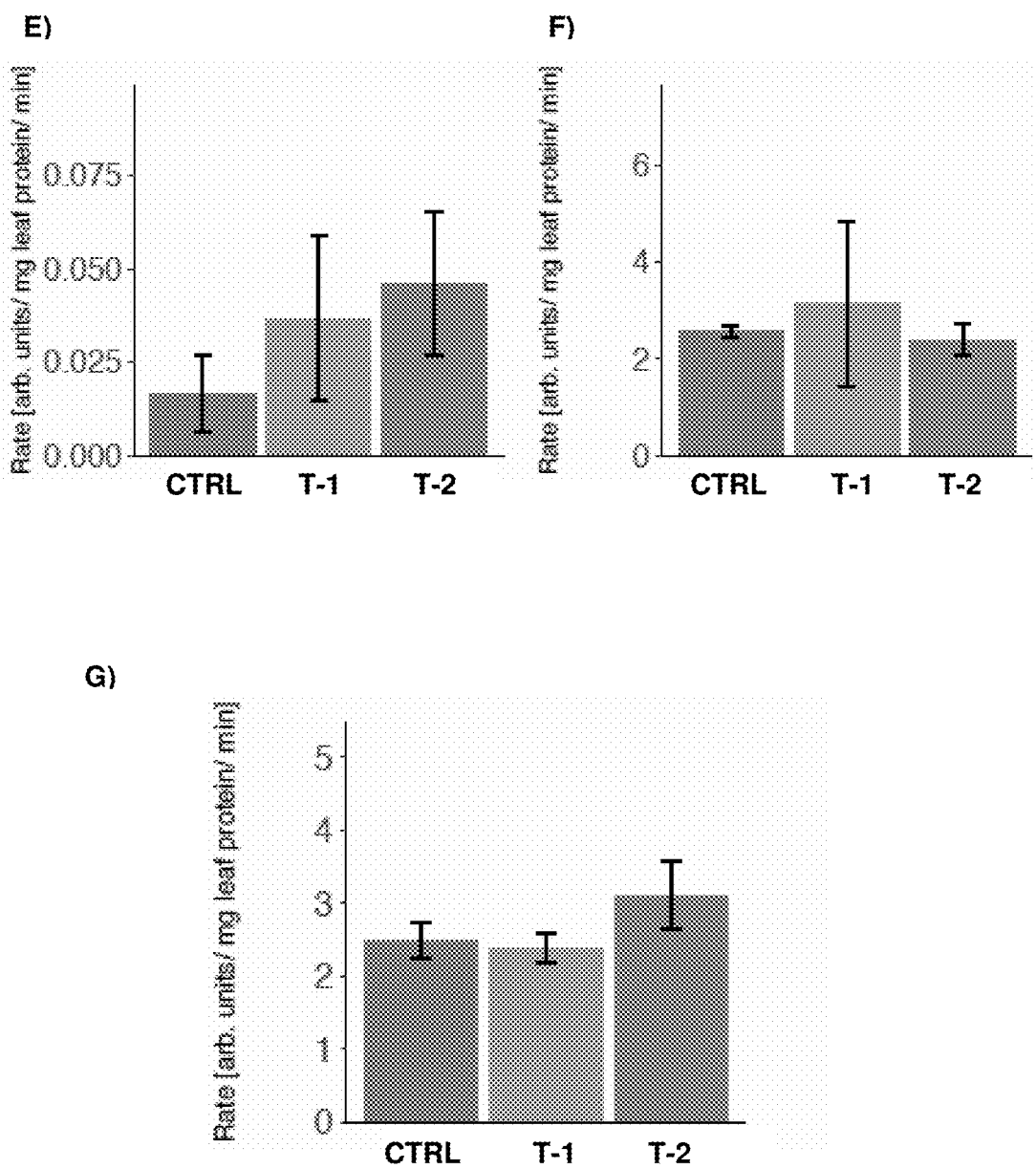

METHOD FOR THE PRODUCTION OF PLANTS WITH ALTERED PHOTORESPIRATION AND IMPROVED CO$_2$ FIXATION

FIELD OF THE INVENTION

The present invention relates to transgenic plants with altered photorespiration and improved CO$_2$ fixation as well as a method of producing said transgenic plants. Particularly, the transgenic plants show an improved growth rate, productivity and energy conversion efficiency.

BACKGROUND OF THE INVENTION

The invention relates to a method for the production of plants with altered photorespiration and improved CO$_2$ fixation. Indeed, biological fixation of CO$_2$ is an important process carried out by plants and a number of microorganisms, which can be harnessed to improve growth, productivity, and/or yield for agricultural crop plants. Many efforts have recently been made to improve growth and resistance of crop plants. Some of the most important crop plants, e.g. rice, wheat, barley, potato, belong to the so-called C3 plants. Only a few important crop plants, like corn and sugar cane, are C4 plants.

CO$_2$ fixation in C3 plants is primarily catalyzed by the enzyme ribulose-1,5-bisphosphate carboxylase (RUBISCO) which is located inside the chloroplasts. The enzyme RUBISCO catalyzes two reactions: carboxylation and oxygenation of ribulose-1,5-bisphosphate. The product of the first reaction are two molecules of 3-phosphoglycerate which enter the Calvin cycle to form starch and ribulose-1, 5-bisphosphate. The products of the oxygenase reaction are each one molecule of 3-phosphoglycerate and phosphoglycolate. The latter is converted to 3-phosphoglycerate in a biosynthetic pathway named photorespiration. In the course of this complex sequence of reactions one molecule of CO$_2$ is released and lost for the plant. This loss of CO$_2$ reduces the formation of sugars and polysaccharides in the plant and thus reduces their productivity. Furthermore, NH$_3$ is released which has to be refixed. High amounts of phosphoglycolate are produced that enter the photorespiratory cycle. It has been estimated that plants loose approximately 25% of the already fixed carbon due to photorespiration. However, this cycle is absolutely intrinsic to all C3 plants because of the oxygenase activity of RUBISCO.

The importance of the photorespiration for plant growth and yield has been shown by experiments where the enhanced CO$_2$ supply indicated that a suppression of photorespiration indeed resulted in higher growth and more yield (Peterhansel and Maurino, *Plant Physiology* 2011).

However, despite several attempts to improve CO$_2$ fixation and reduce photorespiration until now, no suitable method has been provided that leads to an improvement of growth, productivity, and/or yield for agricultural crop plants.

WO2003/100066A1 discloses the re-use of 2-phosphoglycolate produced in photorespiration in a pathway that converts 2-phosphoglycolate into 3-phosphoglycerate. Further, WO2009/103782A1 describes the conversion of glycolate into malate. However, similar to other alternative photorespiration routes, also the pathways disclosed in WO2003/100066A1 and WO2009/103782A1 result in the release of CO$_2$ and therefore do not remedy the major deficit of natural photorespiration. WO2016/207219A1 reports on the conversion of 2-phosphoglycolate into an intermediate compound of the Calvin-Benson-Bassham Cycle. WO 2015/120343 A2 discloses methods and compositions for introduction of a synthetic pathway based on the 3-hydroxypropionate (3OHP) bicycle into host organisms such as cyanobacteria, plants or algae. The heterologous expressed pathway acts as a photorespiratory bypass as well as an additional carbon fixation cycle orthogonal to the endogenous Calvin-Benson cycle (CBC).

The patent application WO 2011/099006 A2 discloses a system for carbon fixation with enzymes which catalyze reactions of a carbon fixation pathway, where at least one of the reactions of the carbon fixation pathway is a carboxylation reaction, where products of the reactions of the carbon fixation pathway comprise oxaloacetate and malonyl-CoA, where an enzyme which performs the carboxylation reaction is selected from the group consisting of phophoenolpyruvate (PEP) carboxylase, pyruvate carboxylase and acetyl-CoA carboxylase, and where an additional export product of the carbon fixation pathway is glyoxylate. In another embodiment, pyruvate is the export product. The system is expressed in bacteria cells, algae cells, and higher plant cells.

Kornberg and Morris (Nature, 1963, 197: 456-457) is a scientific publication disclosing a potential reaction route of *Micrococcus Denitrificans*, partially supported by experimental data, in which two molar units of glyoxylate are converted to one molar unit of oxaloacetic acid. In the reaction route, the authors suppose the transfer of an amino group from β-hydroxyaspartate to glyoxylic acid to yield glycine. To notice, Komber and Morris do not disclose the reactions between β-hydroxyaspartate and oxaloacetic acid. Moreover, Komber and Morris do not disclose which enzymes or genes are involved in the presented reaction route.

The doctoral thesis of T. Schwander "The design and realization of synthetic pathways for the fixation of carbon dioxide in vitro" (2018), discloses the design of synthetic CO$_2$ fixation pathways combining enzymes from different organisms.

Bar-Even et al. (Proceedings of the National Academy of Sciences, 2010, 107, 8889-8894) discloses novel synthetic cycles combining existing metabolic building blocks from various organisms.

EP 1 367 127 A1 is directed to a method for the production of plants with suppressed photorespiration and improved CO$_2$ fixation. In particular, the invention relates to a re-use of phosphoglycolate produced in photorespiration, by installing a glycolate oxidizing pathway inside the chloroplast. This is accomplished by introducing into the plant genome, one or more nucleic acids encoding enzymes of glycolate utilizing pathways, such as (i) glycolate oxidase or glycolate dehydrogenase, (ii) glyoxylate carboligase, and (iii) tatronic semialdehyde reductase. However, data about the transformation efficiency in target plants and the phenotype of transformed plants are not disclosed.

Therefore, it is the objective of the present invention to provide transgenic plants with altered photorespiration and improved CO$_2$ fixation as well as a method of producing said transgenic plants, thereby increasing the growth rate, productivity and energy conversion efficiency of plants.

The objective of the present invention is solved by the teaching of the independent claims. Further advantageous features, aspects and details of the invention are evident from the dependent claims, the description, the figures, and the examples of the present application.

BRIEF DESCRIPTION OF THE INVENTION

The present invention is directed to a method for the production of a transgenic plant with altered photorespiration and improved CO₂ fixation, comprising introducing into a cell or tissue of said plant one or more nucleic acids encoding at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase,
wherein the introduction of said nucleic acid(s) results in a de novo expression of the at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase.

The method of the present invention relates to the bypass of the naturally-occurring photorespiration pathways in plants with the β-hydroxyaspartate pathway (BHAP), which was elucidated by the inventors in proteobacteria, such as in *Paracoccus denitrificans*.

Based on the sequence of a putative β-hydroxyaspartate aldolase gene (dhaa; GenBank Accession No. AB075600) from *Paracoccus denitrificans* IFO 1330123, the inventors have identified a homolog in the genome of *P. denitrificans* DSM413 (BLT64_RS06500), which is part of a gene cluster, consisting of four structural genes and a putative transcriptional regulator. Besides the BHA aldolase (Pden_3919; annotated as alanine racemase), the operon comprises ORFs annotated as coding for serine-glyoxylate aminotransferase (Pden_3921), serine/threonine dehydratase (Pden_3920) and ornithine cyclodeaminase (Pden_3918). The putative transcriptional regulator (Pden_3922; annotated as IclR-family regulator) is in opposite orientation to the four structural genes of the presumed BHAP operon. To verify that these genes indeed encode for the enzymes of the BHAP, the ORFs were cloned and separately overexpressed in *Escherichia coli* BL21. The purified enzymes were tested in spectrophotometric assays to elucidate their function and confirm their role in the BHAP. The inventors could confirm that Pden_3919 encodes for the key enzyme of the BHAP, BHA aldolase, which catalyzes the condensation of glyoxylate and glycine into β-hydroxyaspartate. Furthermore, while Pden_3921 is correctly annotated as a PLP-dependent aminotransferase, the inventors could show that its preferred substrates are aspartate and glyoxylate, which are converted into oxaloacetate and glycine, therefore this enzyme has been here named as aspartate-glyoxylate aminotransferase. The function of Pden_3920 as BHA dehydratase, which had previously been purified from cell-free extracts of *P. denitrificans* (Gibbs and Morris 1965), could be confirmed. Moreover the inventors could show that Pden_3918 encodes for a polypeptide having enzymatic activity of iminosuccinate reductase (and not ornithine cyclodeaminase), which reduces iminosuccinate to L-aspartate, thereby regenerating the amino group donor in the first step of the BHAP. The inventors could further show by phylogenetic analysis that the BHAP is widespread in α- and γ-proteobacteria, in terrestrial as well as marine habitats. There is no prior art document disclosing or suggesting the complete BHAP pathway comprising the enzymes β-hydroxyaspartate aldolase (BHAA), β-hydroxyaspartate dehydratase (BHAD), iminosuccinate reductase (ISRed), and aspartate-glyoxylate transaminase (ASGAT), or disclosing genes coding for any of the BHAP pathway enzymes.

The kinetic parameters of all enzymes of the BHAP are reported in Table 6. The complete reaction sequence of the pathway is shown in FIG. 1. Overall, the β-hydroxyaspartate pathway comprises the conversion of two units of glyoxylate (C2) to one unit oxaloacetate (C4), which can be further metabolized in the tricarboxylic acid (TCA) cycle, under consumption of one unit of the cofactor NADH. In contrast to the natural photorespiration pathways as listed in Table 1 below, no CO₂ is released, no ATP and only 1 equivalent of NADH is required. The BHAP represents a CO₂ neutral photorespiration bypass pathway with the least amount of required reducing equivalents and the regeneration of the catalytic amino donor, which makes it the most efficient glyoxylate assimilation pathway described to date. Thus, the BHAP may lead to an increased growth rate, productivity and energy conversion efficiency of the transgenic plants.

TABLE 1

Comparison of previously published natural photorespiration pathways with the BHAP regarding their substrates, products, and energy requirements. Note that the BHAP compares favorably to all other pathways both in carbon balance and in required energy input.

| Pathway | Substrate(s) | Product(s) | Required ATP | Required reducing equivalents |
|---|---|---|---|---|
| Glycerate pathway | 2 glyoxylate | phosphoglycerate + CO₂ | 1 | 1 |
| Glycine cleavage pathway | 2 glyoxylate + glutamate | phosphoglycerate + CO₂ + 2-oxoglutarate + NH₃ | 1 | 1 |
| Glyoxylate oxidation | 2 glyoxylate | 4 CO₂ | — | 2 |
| BHAP | 2 glyoxylate | oxaloacetate | — | 1 |

In the BHAP (FIG. 1), the enzyme (a) β-hydroxyaspartate aldolase (BHAA) catalyzes the condensation of glycine and glyoxylate to (2R,3S)-β-hydroxyaspartate and the enzyme (b) β-hydroxyaspartate dehydratase (BHAD) catalyzes the subsequent dehydration to iminosuccinate. The iminosuccinate is reduced to aspartate by the (c) iminosuccinate reductase (ISRed) in the presence of the cofactor NADH and the formed aspartate is finally converted with glyoxylate to oxaloacetate and glycine in the presence of the enzyme (d) aspartate-glyoxylate transaminase (AsGAT). Oxaloacetate formed in the BHAP can directly enter the tricarboxylic acid cycle or the gluconeogenesis in the cytosol.

The inventors have successfully integrated the four genes of the BHAP from *Paracoccus denitrificans* DSM413 and from other microorganisms in plant peroxisomes, where a high concentration of photorespiration-derived glyoxylate is expected. To this aim, the four required genes of the BHAP were codon-optimized for expression in *Arabidopsis thaliana* by gene synthesis; moreover four enzymes were targeted to plant peroxisomes by synthetic fusion with peroxisomal targeting sequences. The inventors were able to demonstrate the correct localization of BHAP enzymes in plant peroxisomes (FIG. 3), by means of co-localization studies with peroxisomal organellar markers.

Moreover, the inventors were able to demonstrate activity of each of the BHAP enzymes in *N. benthamiana* leaf extracts (FIGS. 4-7). In order to differentiate the activity of IsRed from malate dehydrogenase activity, the formation of aspartate (via IsRed) and malate (via malate dehydrogenase) was quantified via LC-MS. As shown, both aspartate and malate were formed in the respective enzyme assay (FIG. 8), with the ratio of malate:aspartate being approximately 100 towards the end of the assay (FIG. 9).

Finally, the inventors constructed a multigene T-DNA nucleic acid construct for implementation of the BHAP in plants (FIG. 10). Functionality of this nucleic acid construct, regarding expression of all four enzymes was verified by transient expression in *N. benthamiana* followed by immunoblot analysis (FIG. 11-12). Although constitutive expression of multiple transgenes is a predominant approach in plants and might be of interest for future studies, the inventors use a fine-tuned approach of BHAP expression in plants. Within the multigene nucleic acid construct each BHAP enzyme is expressed under its own photosynthetically regulated promoter, restricting BHAP expression to photosynthetic tissue and coupling BHAP expression to light and high photorespiratory metabolic flux.

The inventors have successfully integrated the four genes of the BHAP at two different neutral sites of the chromosome of *S. elongatus* PCC7942 (see Example 11). This was done both in the wild type strain and in a deletion strain that lacks the genes necessary for the formation of carboxysomes (ccmK-O), and therefore requires elevated atmospheric $CO_2$ concentrations for growth (this strain is henceforth referred to as ΔK-O). As shown in FIG. 13, the activity of each single enzyme in the ΔK-O strain was at least 300 mU/mg, while the reaction sequence from glycine and glyoxylate to aspartate (via BHA aldolase, BHA dehydratase and iminosuccinate reductase) was measured at an activity of ~100 mU/mg, notably without any additional coupling enzymes, thereby verifying the successful expression of the pathway enzymes as well as the maintenance of the enzyme activity. The expression level of the BHAP enzymes is high enough to sustain photorespiratory flux in *S. elongatus* PCC7942 ΔK-O. In addition, the inventors could show in growth experiments that the implantation of the BHAP in microorganisms permits a more than 20% faster growth of the microorganism at 30° C. and 37° C. (see Table 9 and FIGS. 14 and 15) compared to the ΔK-O control strain. Therefore, it was successfully demonstrated that the bypass of the naturally-occurring photorespiration pathways in autotrophic microorganisms with the β-hydroxyaspartate pathway (BHAP) by the inventive method results in a faster growth of the autotrophic microorganisms.

Of relevance, the inventor successfully stably integrated the BHAP synthetic pathway in *Arabidopsis thaliana* wild-type plants (Col-0) and in ggt-1 mutant (FIG. 16). The established transgenic lines with the BHAP in WT and ggt1 mutant background were analyzed for phenotype (Example 8), enzymatic activity of all four BHAP enzymes (Example 7), and metabolomic profile (Example 9). Results showed that the transgenic plants engineered with the BHAP performed markedly better than the ggt1 mutant background (FIGS. 18-20), and expressed the functional enzymes in active form of the BHAP (FIGS. 17 and 23).

Therefore, it can be concluded that implementation of the β-hydroxyaspartate pathway (BHAP) in plants results in an increased growth, productivity, and/or yield for agricultural crop plants.

DESCRIPTION OF THE INVENTION

Definitions

Throughout this specification amino acid residues will be denoted by the three-letter abbreviation or single-letter code as follows:

| Amino Acid | Three-letter abbreviation | One-letter Symbol |
|---|---|---|
| Alanine | Ala | A |
| Arginine | Arg | R |
| Asparagine | Asn | N |
| Aspartic Acid | Asp | D |
| Cysteine | Cys | C |
| Glutamine | Gln | Q |
| Glutamic Acid | Glu | E |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

The term "plants" as used herein includes, unless indicated otherwise, plant bodies, plant organs, plant tissues, plant cells, and seeds. An example of a plant cell includes callus. An example of a plant organ includes a root, a leaf, a flower and the like, In contrast, microscopic organism, i.e. microorganisms, which may exist in its single-celled form or in a colony of cells and which is not visible to the naked eye as individual, are not considered as plants herein.

The term "C3 plants" refers to plants which fix $CO_2$ in a C3 pathway of photosynthesis, including monocotyledonous plants such as rice, wheat, and barley, as well as dicotyledonous plants such as soybeans, potatoes, and sweet potatoes.

The term "C4 plants" refers to plants which fix $CO_2$ in the C4 pathway of photosynthesis, including monocotyledonous plants such as maize, sugarcane, and sorghum, as well as dicotyledonous plants such as *Flaveria*, and *Amaranthus*.

"Iminosuccinate reductase" as used herein refers to a polypeptide having an iminosuccinate reductase activity, i.e. an iminosuccinate reductase catalyzes the reaction of iminosuccinate (or iminoaspartate) to aspartate in the presence of a cofactor such as NADH. It is to be understood that iminosuccinate reductases are not limited to polypeptide variants derived from the naturally occurring iminosuccinate reductases from various bacteria, such as *Paracoccus denitrificans*, but may include other enzymes having iminosuccinate reductase activity, or recombinant variants of the naturally occurring iminosuccinate reductases, including but not limiting enzymes comprising an amino acid sequence selected from proteobacteria SEQ ID NO: 1-299, such as *Paracoccus denitrificans* (SEQ ID NO: 135).

As used herein, "erythro-β-hydroxyaspartate aldolase" (or synonymously L-erythro-3-hydroxyaspartate aldolase) refers to a polypeptide having a β-hydroxyaspartate aldolase activity, i.e. a polypeptide that catalyzes the reaction of glyoxylate and glycine to erythro-β-hydroxyaspartate. The β-hydroxyaspartate aldolase belongs to the EC class 4.1.3.14. This enzyme is closely related to D-threonine aldolases and differs in the active site by three amino acids A160, A195 and S313, which may provide a signature sequence for this enzyme family (data not shown).

As used herein, "erythro-β-hydroxyaspartate dehydratase" (or synonymously erythro-3-hydroxy-L-aspartate ammonia-lyase) refers to a polypeptide having a β-hydroxyaspartate dehydratase activity, i.e. a polypeptide that catalyzes the reaction of erythro-β-hydroxyaspartate to iminosuccinate. The β-hydroxyaspartate dehydratase belongs to the EC class 4.3.1.20 or former EC class 4.2.1.38.

"aspartate-glyoxylate transaminase" as used herein refers to a polypeptide having an aspartate-glyoxylate transaminase activity, i.e. an aspartate-glyoxylate transaminase catalyzes the reaction of aspartate and glyoxylate to oxaloacetate and glycine. It is to be understood that aspartate-glyoxylate transaminases are not limited to polypeptide variants derived from the naturally occurring aspartate-glyoxylate transaminases from various bacteria, such as *Paracoccus denitrificans*, but may include other enzymes having aspartate-glyoxylate transaminase activity, or recombinant variants of the naturally occurring aspartate-glyoxylate transaminases, including but not limiting enzymes comprising an amino acid sequence selected from proteobacteria SEQ ID NO: 300-599, such as *Paracoccus denitrificans* (SEQ ID NO: 433).

"Percentage of sequence identity" and "percentage homology" are used interchangeably herein to refer to comparisons among nucleic acids and polypeptides, and are determined by comparing two optimally aligned sequences over a comparison window, wherein the portion of the nucleic acids or polypeptide sequence in the comparison window may comprise additions or deletions (i.e. gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two nucleic acids or polypeptides may each (1) comprise a sequence (i.e., a portion of the complete sequence) that is similar between the two sequences, and (2) may further comprise a sequence that is divergent between the two sequences, sequence comparisons between two (or more) nucleic acids or polypeptide are typically performed by comparing sequences of the two nucleic acids or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

"Substantial identity" refers to a nucleic acid or polypeptide sequence that has at least 80 percent sequence identity, at least 85 percent identity and 89 to 95 percent sequence identity, more usually at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In specific embodiments applied to polypeptides, the term "substantial identity" means that two polypeptide sequences, when optimally aligned, share at least 80 percent sequence identity, preferably at least 89 percent sequence identity, at least 95 percent sequence identity or more (e.g., 99 percent sequence identity). Preferably, residue positions which are not identical differ by conservative amino acid substitutions.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered imine reductase enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. In some embodiments, the improved engineered imine reductase enzymes comprise insertions of one or more amino acids to the naturally occurring polypeptide having imine reductase activity as well as insertions of one or more amino acids to other improved imine reductase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

"Synthetic nucleotide sequence" as used herein means a nucleotide sequence comprising structural characters that are not present in the natural sequence. For example, an artificial sequence that resembles more closely the G+C content and the normal codon distribution of dicot and/or monocot genes is said to be synthetic. A regulatory DNA sequence is said to be "operably linked to" or "associated with" a DNA sequence that codes for an RNA or a protein if the two sequences are situated such that the regulatory DNA sequence affects expression of the coding DNA sequence.

The term "promoter" or "promoter region" refers to a nucleic acid sequence, usually found upstream (5') to a coding sequence that controls expression of the coding sequence by controlling production of messenger RNA (mRNA) by providing the recognition site for RNA polymerase and/or other factors necessary for start of transcription at the correct site. As contemplated herein, a promoter or promoter region includes variations of promoters derived by means of ligation to various regulatory sequences, random or controlled mutagenesis, and addition or duplication of enhancer sequences. The promoter region disclosed herein, and biologically functional equivalents thereof, are responsible for driving the transcription of coding sequences under their control when introduced into a host as part of a suitable recombinant vector, as demonstrated by its ability to produce mRNA. The promoter region may also include elements that act as regulators of gene expression such as activators, enhancers, and/or repressors.

The term "terminator" region refers to a sequence of DNA that causes RNA polymerase to terminate transcription. Suitable terminator sequences contemplated herein are: *Agrobacterium tumefaciens* octopine synthase terminator (AtuOCSt), *Agrobacterium tumefaciens* nopaline synthase terminator (AtuNOSt), 35S terminator derived from the Cauliflower Mosaic Virus (35St), *Solanum lycopersicum* RubisCO small subunit 3C terminator (SIRbcS3Ct).

As used herein, the term "selection marker" gene or nucleic acid includes any gene which confers a phenotype on a cell in which it is expressed to facilitate the identification and/or selection of cells which are transfected or transformed with a genetic construct of the invention or a derivative thereof.

Suitable "selection marker" genes or nucleic acids contemplated herein include the ampicillin-resistance, tetracycline-resistance gene, kanamycin-resistance gene (KanR), zeocin resistance gene, the AURI-C gene conferring resistance to the antibiotic aureobasidin A, phosphinothricin-resistance gene, neomycin phosphotransferase gene (nptII), hygromycin-resistance gene, glucuronidase gene, chloramphenicol acetyltransferase (CAT) gene, green fluorescent protein (GFP) encoding gene or the luciferase encoding gene, amongst others.

Preferably, the selectable marker gene is the kanamycin resistance (KanR) encoding gene.

"Heterologous" as used herein means "of different natural or of synthetic origin" or represent a nonnatural state. For example, if a host cell or microorganism is transformed with a nucleic sequence derived from another organism, particularly from another microorganism, that gene is heterologous with respect to that host cell or microorganism and also with respect to descendants of the host cell which carry that gene. The transforming nucleic acid may comprise a heterologous promoter, heterologous coding sequence, or heterologous termination sequence. Alternatively, the transforming nucleic acid may be completely heterologous or may comprise any possible combination of heterologous and endogenous nucleic acid sequences.

"Transformation" refers to a process of introducing an exogenous nucleic acid sequence (e.g., a vector, recombinant nucleic acid molecule) into a cell or protoplast in which that exogenous nucleic acid is incorporated into a chromosome or is capable of autonomous replication.

A "transformed cell" is a cell whose nucleic acid has been altered by the introduction of an exogenous nucleic acid molecule into that cell.

A "transformed plant" or "transgenic plant" is a plant whose nucleic acid has been altered by the introduction of an exogenous nucleic acid molecule into that plant, or by the introduction of an exogenous nucleic acid molecule into a plant cell from which the plant was regenerated or derived. As disclosed herein, a transgenic plant comprises one or more nucleic acids encoding four polypeptides having the enzymatic activities of a) erythro-β-hydroxyaspartate aldolase, (b) erythro-β-hydroxyaspartate dehydratase, (c) iminosuccinate reductase, and (d) aspartate-glyoxylate transaminase, and wherein BHAP can be implemented in cytosol or peroxisomes. If the BHAP is implemented in the mitochondria, the transgenic plant according to the present invention comprises one or more nucleic acids encoding five polypeptides having the enzymatic activities of a) erythro-β-hydroxyaspartate aldolase, (b) erythro-β-hydroxyaspartate dehydratase, (c) iminosuccinate reductase, (d) aspartate-glyoxylate transaminase, and (e) glycolate dehydrogenase. If the BHAP is implemented in the chloroplasts, the transgenic plant according to the present invention comprises one or more nucleic acids encoding six polypeptides having the enzymatic activities of a) erythro-β-hydroxyaspartate aldolase, (b) erythro-β-hydroxyaspartate dehydratase, (c) iminosuccinate reductase, (d) aspartate-glyoxylate transaminase, (e) glycolate dehydrogenase, and (f) phosphoenolpyruvate carboxykinase.

The nucleic acid constructs as described herein includes at least one promoter, the coding regions of multiple genes encoding one or more proteins, selection marker genes, and sequences transcription termination. The constructs may also include sequences encoding targeting sequences, such as sequences encoding plastid targeting sequences, or tissue specific sequences, such as peptides specific targeting seed. These constructs are made using the MoClo kit. The transfer DNA (abbreviated T-DNA) is the transferred DNA of the tumor-inducing (Ti) plasmid of some species of bacteria such as *Agrobacterium tumefaciens*. The T-DNA is transferred from bacterium into the host plant's nuclear DNA genome. The capability of this specialized tumor-inducing (Ti) plasmid is attributed to two essential regions required for DNA transfer to the host cell. *Agrobacterium*-mediated T-DNA transfer is widely used as a tool in biotechnology for introducing genes into plants for basic research as well as for commercial production of transgenic crops. In genetic engineering, the tumor-promoting and opine-synthesis genes are removed from the T-DNA and replaced with a gene of interest and/or a selection marker, which is required to establish which plants have been successfully transformed. Examples of selection markers include kanamycin, neomycin phosphotransferase, hygromycin B phosphotransferase, and phosphinothricin acetyltransferase. *Agrobacterium* is then used as a vector to transfer the engineered T-DNA into the plant cells where it integrates into the plant genome. This method can be used to generate transgenic plants carrying a foreign gene. *Agrobacterium tumefaciens* is capable of transferring foreign DNA to both monocotyledons and dicotyledonous plants efficiently while taking care of critically important factors like the genotype of plants, types and ages of tissues inoculated, kind of vectors, strains of *Agrobacterium*, selection marker genes and selective agents, and various tissue culture conditions.

The present invention is directed to a method for the production of a transgenic plant with altered photorespiration and improved $CO_2$ fixation, comprising introducing into a cell or tissue of said plant one or more nucleic acids encoding at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the introduction of said nucleic acid(s) results in a de novo expression of the at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase.

It is to be understood that all four enzymes of the BHAP must be expressed in the transgenic plant in order to alter the photorespiration and to improve the $CO_2$ fixation in said plants. Therefore, the step introducing into a cell or tissue of said plant one or more nucleic acids encoding polypeptides having the enzymatic activities (a)-(d) refers to (i) a single nucleotide encoding all four polypeptides having the enzymatic activities (a)-(d), or (ii) the implementation of multiple nucleic acids which encode together the polypeptides having the enzymatic activities (a)-(d). For example, the BHAP may be implemented in a transgenic plant according to the present invention by using 4 nucleic acids, each encoding a different polypeptide having the enzymatic activities (a)-(d).

In other words, the present invention is directed to a method for the production of a transgenic plant with altered photorespiration and improved $CO_2$ fixation, comprising introducing into a cell or tissue of said plant one or more nucleic acids encoding at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the introduction of all said nucleic acid(s) results in a de novo expression of the at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase.

Reworded, the present invention is directed to a method for the production of a transgenic plant with altered photorespiration and improved $CO_2$ fixation, comprising introducing into a cell or tissue of said plant one or more nucleic acids encoding polypeptides comprising Pden 3919 (GenBank: ABL71985), Pden 3920 (GenBank: ABL71986), Pden 3918 (GenBank: ABL71984) and Pden_3921 (GenBank: ABL71987) or homologs or variants thereof, wherein the introduction of said nucleic acid(s) results in a de novo expression of the polypeptides Pden_3919, Pden_3920, Pden_3918 and Pden_392, wherein Pden_3919 has the enzymatic activity of an (a) erythro-β-hydroxyaspartate Pden_3920 has the enzymatic activity of an (b) erythro-β-hydroxyaspartate dehydratase, Pden_3918 has the enzymatic activity of an (c) iminosuccinate reductase, and Pden_3921 has the enzymatic activity of an (d) aspartate-glyoxylate transaminase.

Thus, in one embodiment the method for the production of a transgenic plant with altered photorespiration and improved $CO_2$ fixation, comprises introducing into a cell or tissue of said plant one nucleic acid encoding at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the introduction of said nucleic acid results in a de novo expression of the at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase.

By phylogenetic analysis the inventors have revealed that the BHAP is widely distributed among proteobacteria, particularly alpha- and gamma-proteobacteria, such as *Aestuariivita boseongensis, Agrobacterium* sp., *Ahrensia* sp., *Aminobacter aminovorans, Amphritea atlantica, Antarctobacter heliothermus, Aquisalimonas asiatica, Aurantimonas altamirensis, Aureimonas altamirensis, Brevirhabdus pacifica, Citreicella marina, Citreicella* sp., *Citreicella thiooxidans, Citreimonas salinaria, Colwellia piezophila, Colwellia psychrerythraea, Colwellia* sp, *Cribrihabitans marinus, Defluviimonas indica, Defluviimonas* sp., *Dinoroseobacter shibae, Ensifer fredii, Ensifer meliloti, Ensifer* sp., *Glaciecola* sp., *Granulosicoccus antarcticus, Halocynthiibacter* sp., *Hasllibacter halocynthiae, Hyphomicrobium sulfonivorans, Jannaschia pohangensis, Jannaschia rubra, Jannaschia* sp., *Labrenzia aggregata, Labrenzia alba, Labrenzia alexandrii, Labrenzia* sp., *Leisingera aquaemixtae, Leisingera nanhaiensis, Leisingera* sp., *Litoreibacter ascidiaceicola, Litoreibacter halocynthiae, Litoreibacter janthinus, Litoreibacter meonggei, Litoreibacter ponti, Loktanella koreensis, Loktanella litorea, Loktanella maricola, Loktanella rosea, Loktanella sediminilitoris, Loktanella sediminum, Loktanella* sp., *Loktanella vestfoldensis, Mameliella alba, Maribius* sp., *Marinobacter psychrophilus, Marinobacter* sp., *Marinobacterium lutimaris, Marinobacterium mangrovicola, Marinobacterium* sp., *Marinomonas* sp., *Marinovum algicola, Maritimibacter* sp., *Marivita geojedonensis, Marivita hallyeonensis, Mesorhizobium* sp., *Mesorhizobium* sp., *Methylobacterium komagatae, Methylobacterium mesophilicum, Methylobacterium radiotolerans, Methylobacterium* sp., *Methylobacterium* sp., *Methylopila* sp., *Neptunomonas antarctica, Nitratireductor* sp., *Oceanicola flagellatus, Oceanicola nitratireducens, Oceanicola* sp., *Oceaniovalibus guishaninsula, Octadecabacter antarcticus, Octadecabacter arcticus, Octadecabacter temperatus, Palleronia marisminoris, Leisingera aquimarina, Paracoccus alcaliphilus, Paracoccus alkenifer, Paracoccus aminophilus, Paracoccus aminovorans, Paracoccus denitrificans, Paracoccus halophilus, Paracoccus homiensis, Paracoccus isoporae, Paracoccus pantotrophus, Paracoccus saliphilus, Paracoccus sediminis, Paracoccus* sp., *Paracoccus thiocyanatus, Paracoccus versutus, Paracoccus yeei, Pararhodobacter aggregans, Phaeobacter caeruleus, Phaeobacter daeponensis, Pelagibaca bermudensis, Pelagicola*

*litoralis, Pelagimonas varians, Phaeobacter gallaeciensis, Phaeobacter inhibens, Planktotalea frisia, L. methylohalidivorans, Ponticoccus litoralis, Ponticoccus* sp., *Poseidonocella pacifica, Pseudomonas stutzeri, Pseudopelagicola gijangensis, Pseudorhodobacter antarcticus, Pseudoruegeria haliotis, Pseudoruegeria marinistellae, Psychrobacter arcticus, Psychrobacter cryohalolentis, Psychrobacter* sp., *Psychrobacter urativorans, Puniceibacterium sediminis, Rhizobium etli, Rhizobium etli, Rhizobium etli, Rhizobium leguminosarum, Rhizobium lusitanum, Rhizobium rhizogenes, Rhizobium* sp., *Rhizobium taibaishanense, Rhizobium tropici, Rhizobium yanglingense, Rhodobaca barguzinensis, Rhodobacteraceae bacterium, Rhodobacteraceae* sp., *Rhodobacterales bacterium, Rhodovibrio salinarum, Rhodovulum kholense, Rhodovulum* sp., *Rhodovulum sulfidophilum, Roseinatronobacter thiooxidans, Roseivivax halodurans, Roseivivax isoporae, Roseivivax lentus, Roseivivax sediminis, Roseobacter denitrificans, Roseobacter litoralis, Roseobacter* sp., *Roseovarius azorensis, Roseovarius indicus, Roseovarius litoreus, Roseovarius lutimaris, Roseovarius marisflavi, Roseovarius mucosus, Roseovarius nubinhibens, Roseovarius sediminilitoris, Roseovarius* sp., *Roseovarius tolerans, Rubellimicrobium mesophilum, Rubrimonas cliftonensis, Ruegeria atlantica, Ruegeria conchae, Ruegeria faecimaris, Ruegeria halocynthiae, Ruegeria marina, Ruegeria mobilis, Ruegeria scottomollicae, Ruegeria* sp., *Sagittula stellata, Salinihabitans flavidus, Shimia haliotis, Shimia sagamensis, Silicibacter* sp., *Sinorhizobium americanum, Sinorhizobium fredii, Sinorhizobium terangae, Solemya velum, Sphingomonas* sp., *Stappia aggregata, Starkeya novella, Sulfitobacter pseudonitzschiae, Sulfitobacter* sp., *Tateyamaria omphalii, Tateyamaria* sp., *Thalassobacter* sp., *Thalassobacter stenotrophicus, Thalassobius abyssi, Thalassobius aestuarii, Thalassobius mediterraneus, Thalassotalea* sp., *uncultured Rhodobacteriaceae, Yangia pacifica, Yangia pacifica, Yangia* sp., *Paracoccus sulfuroxidans, AP Rhodobacteraceae bacterium* and *Silicibacter pomeroyi*.

Therefore, the inventive method is not restricted to the BHAP enzymes of *P. denitrificans* DSM413, and BHAP enzymes with same activity of other origin, particularly proteobacteria, can be used as well. Thus, the method for the production of a transgenic plant with altered photorespiration and improved $CO_2$ fixation, comprises introducing into a cell or tissue of said plant one or more nucleic acids encoding at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase,
wherein the introduction of said nucleic acid(s) results in a de novo expression of the at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase,
wherein the de novo expressed polypeptides having the enzymatic activities (a) erythro-β-hydroxyaspartate aldolase, (b) erythro-β-hydroxyaspartate dehydratase, (c) iminosuccinate reductase and (d) aspartate-glyoxylate transaminase are preferably derived from proteobacteria.

Moreover, in the inventive methods described herein, the de novo expressed polypeptides having the enzymatic activities (a) erythro-β-hydroxyaspartate aldolase, (b) erythro-β-hydroxyaspartate dehydratase, (c) iminosuccinate reductase and (d) aspartate-glyoxylate transaminase are preferably derived from alpha- or gamma-proteobacteria. Also, in the inventive methods described herein, the de novo expressed polypeptides having the enzymatic activities (a) erythro-β-hydroxyaspartate aldolase, (b) erythro-β-hydroxyaspartate dehydratase, (c) iminosuccinate reductase and (d) aspartate-glyoxylate transaminase are preferably derived from proteobacteria which belong to the genus selected from *Aquisalimonas, Poseidonocella, Marinobacter, Litoreibacter, Thalassobacter, Ruegeria, Paracoccus, Roseobacter, Leisingera, Loktanella, Methylobacterium, Sinorhizobium, Rhizobium, Agrobacter, Cribrihabitans, Dinoroseobacter, Octadecabacter, Planktotalea, Psychrobacter, Yangia, Pseudorhodobacter* or *Neptunomonas*. In one embodiment of the inventive method, the de novo expressed polypeptides having the enzymatic activities (a) erythro-β-hydroxyaspartate aldolase, (b) erythro-β-hydroxyaspartate dehydratase, (c) iminosuccinate reductase and (d) aspartate-glyoxylate transaminase are preferably derived from *Paracoccus denitrificans*.

Thus, the method for the production of a transgenic plant with altered photorespiration and improved $CO_2$ fixation, comprises introducing into a cell or tissue of said plant one or more nucleic acids encoding at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase,
wherein the introduction of said nucleic acid(s) results in a de novo expression of the at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase,
wherein the polypeptide having the enzymatic activity of (c) iminosuccinate reductase comprises an amino acid sequence selected from SEQ ID NOs: 1-299, or an amino acid sequence having at least 80% sequence identity to a sequence selected from SEQ ID NO: 1-299;
and the polypeptide having the enzymatic activity of (d) aspartate-glyoxylate transaminase comprises an amino acid sequence selected from SEQ ID NOs: 300-599, or an amino acid sequence having at least 80% sequence identity to a sequence selected from SEQ ID NO: 300-599.

The iminosuccinate reductase enzymes of SEQ ID NOs: 1-299 comprise the conserved amino acid sequence of $GX_aKX_aG(X_a)_4(X_c)_2(X_a)_2GX_aKX_aGG(X_a)_2PX_aN(X_a)_3X_c(X_a)_3NHQS(X_a)_3LF(X_a)_4G(X_a)_8N$ $(X_a)_2TAX_aRTAA(X_a)_4S(X_a)_3L(X_a)_8G(X_a)_2GAGX_aQ(X_a)_3Q(X_a)_{15}WN(X_a)_{28}(X_c)_2(X_a)_9S(X_a)_1$ $_5H(X_a)_3MGTDT(X_a)_2KX_aE(X_a)_{13}D(X_a)_3Q(X_a)_4GEX_aQ(X_a)_{16}G(X_a)_9R(X_a)_2X_c(X_a)_3T(X_a)_2D$ $GX_aG(X_a)_3QDX_aA$ (SEQ ID NO: 967), wherein $X_a$ represents independently for each occurrence an amino acid, and wherein $X_c$ represents independently for each occurrence an amino acid or a gap.

The aspartate-glyoxylate transaminase enzymes of SEQ ID NOs: 300-599 comprise the conserved amino acid sequence of $W(X_b)_{12}L(X_b)_2D(X_b)_1(X_c)_2$ $(X_b)_9NETX_bTGVX_bS(X_b)_{20}DX_bVSS(X_b)_5F(X_b)_4W(X_b)_2D$ $(X_b)_4G$ $SQKGX_bM(X_b)_3G(X_b)_{31}(X_c)_4(X_b)_3PX_bTP(X_b)_6G$ $(X_b)_9X_cX_bE(X_b)_7RH(X_b)_3A(X_b)_3R(X_b)_5W$ $(X_b)_5A(X_b)_6S$ $(X_b)_8P(X_b)_{20}GX_bG(X_b)_8FRX_bGHX_bG(X_b)_{14}E(X_b)_{12}GX_bG$ $(X_b)_2AA$ (SEQ ID NO: 968), wherein $X_b$ represents independently for each occurrence an amino acid or a gap, and wherein $X_c$ represents independently for each occurrence an amino acid or a gap.

The conserved amino acid sequences SEQ ID NO 967 of the iminosuccinate reductase enzymes SEQ ID NO 1-299, and SEQ ID NO 968 of the aspartate-glyoxylate transaminase enzymes SEQ ID NOs: 300-599, have been designed with the help of Clustal Omega, which is a multiple sequence alignment program found at www.ebi.ac.uk/Tools/msa/clustalo/, using the "default parameters". The optimal multiple alignment between the input sequences in the comparison window is achieved by inserting deletions or gaps in the aligned sequences by the Clustal omega software. The maximal number of gaps inserted in one sequence to this aim was 4 for the alignment of the SEQ ID NOs 1-299, and 5 for the alignment of the sequences SEQ ID NOs 300-599. The conserved amino acid sequence SEQ ID NO 967 represents the 100% consensus sequence obtained by the multiple alignment of SEQ ID NOs 1-299. The conserved amino acid sequence SEQ ID NO 968 represents the 100% consensus sequence obtained by the multiple alignment of SEQ ID NOs 300-599.

Thus, in one embodiment, the method for the production of a transgenic plant with altered photorespiration and improved $CO_2$ fixation, comprises introducing into a cell or tissue of said plant one or more nucleic acids encoding at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the introduction of said nucleic acid(s) results in a de novo expression of the at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the polypeptide having the enzymatic activity of (c) iminosuccinate reductase comprises the conserved amino acid sequence of $GX_aKX_aG(X_a)_4(X_c)_2(X_a)_2GX_aKX_aGG$ $(X_a)_2PX_aN(X_a)_3X_c(X_a)_3NHQS(X_a)_3LF(X_a)_4G(X_a)_8N$ $(X_a)_2TAX_aRTAA(X_a)_4S(X_a)_3L(X_a)_8G(X_a)_2GAGX_a$ $Q(X_a)_3Q(X_a)_{15}WN(X_a)_{28}(X_c)_2(X_a)_8S(X_a)_{15}H(X_a)_3$ $MGTDT(X_a)_2KX_aE(X_a)_{13}D(X_a)_3Q(X_a)_4GEX_aQ(X_a)_{16}G$ $(X_a)R(X_a)_2X_c(X_a)_3T(X_a)_2D$ $GX_aG(X_a)_3QDX_aA$ (SEQ ID NO: 967), wherein $X_a$ represents independently for each occurrence an amino acid, wherein $X_c$ represents independently for each occurrence an amino acid or a gap, and wherein said polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
and the polypeptide having the enzymatic activity of (d) aspartate-glyoxylate transaminase comprises the conserved amino acid sequence of $W(X_b)_{12}L(X_b)_2D(X_b)_1(X_c)_2$ $(X_b)_9NETX_bTGVX_bS(X_b)_{20}DX_bVSS(X_b)_5F(X_b)_4W(X_b)_2D$ $(X_b)_4G$ $SQKGX_bM(X_b)_3G(X_b)_{31}(X_c)_4(X_b)_3PX_bTP(X_b)_6G$ $(X_b)_9X_cX_bE(X_b)_7RH(X_b)_3A(X_b)_3R(X_b)_5W$ $(X_b)_5A(X_b)_6S$ $(X_b)_8P(X_b)_{20}GX_bG(X_b)_8FRX_bGHX_bG(X_b)_{14}E(X_b)_{12}GX_bG$ $(X_b)_2AA$ (SEQ ID NO: 968), wherein $X_b$ represents independently for each occurrence an amino acid, wherein $X_c$ represents independently for each occurrence an amino acid or a gap, and said polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599.

In one embodiment, the method for the production of a transgenic plant with altered photorespiration and improved $CO_2$ fixation, comprises introducing into a cell or tissue of said plant one or more nucleic acids encoding at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the introduction of said nucleic acid(s) results in a de novo expression of the at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the polypeptide having the enzymatic activity of (c) iminosuccinate reductase comprises the conserved amino acid sequence of $GX_aKX_aG(X_a)_4(X_c)_2(X_a)_2GX_aKX_aGG$ $(X_a)_2PX_aN(X_a)_3X_c(X_a)_3NHQS(X_a)_3LF(X_a)_4G(X_a)_8N$ $(X_a)_2TAX_aRTAA(X_a)_4S(X_a)_3L(X_a)_8G(X_a)_2GAGX_a$ $Q(X_a)_3Q(X_a)_{15}WN(X_a)_{28}(X_c)_2(X_a)_9S(X_a)_{15}H(X_a)_3$ $MGTDT(X_a)_2KX_aE(X_a)_{13}D(X_a)_3Q(X_a)_4GEX_aQ(X_a)_{16}G$ $(X_a)_9R(X_a)_2X_c(X_a)_3T(X_a)_2D$ $GX_aG(X_a)_3QDX_aA$ (SEQ ID NO: 967), wherein $X_a$ represents independently for each occurrence an amino acid, wherein $X_c$ represents independently for each occurrence an amino acid or a gap, and wherein said polypeptide having the enzymatic activity of (c) iminosuccinate reductase comprises an amino acid sequence having at least 80% sequence identity to a sequence selected from SEQ ID NO: 1-299;
and the polypeptide having the enzymatic activity of (d) aspartate-glyoxylate transaminase comprises the conserved amino acid sequence of $W(X_b)_{12}L(X_b)_2D(X_b)_1(X_c)_2$ $(X_b)_9NETX_bTGVX_bS(X_b)_{20}DX_bVSS(X_b)_5F(X_b)_4W(X_b)_2D$ $(X_b)_4G$ $SQKGX_bM(X_b)_3G(X_b)_{31}(X_c)_4(X_b)_3PX_bTP(X_b)_6G$ $(X_b)_9X_cX_bE(X_b)_7RH(X_b)_3A(X_b)_3R(X_b)_5W$ $(X_b)_5A(X_b)_6S$ $(X_b)_8P(X_b)_{20}GX_bG(X_b)_8FRX_bGHX_bG(X_b)_{14}E(X_b)_{12}GX_bG$ $(X_b)_2AA$ (SEQ ID NO: 968), wherein $X_b$ represents independently for each occurrence an amino acid, wherein $X_c$ represents independently for each occurrence an amino acid or a gap, and said polypeptide having the enzymatic activity of (d) aspartate-glyoxylate transaminase comprises an amino acid sequence having at least 80% sequence identity to a sequence selected from SEQ ID NO: 300-599.

In one embodiment, the method for the production of a transgenic plant with altered photorespiration and improved $CO_2$ fixation, comprises introducing into a cell or tissue of said plant one or more nucleic acids encoding at least four polypeptides having the enzymatic activities of (a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the introduction of said nucleic acid(s) results in a de novo expression of the at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the polypeptide having the enzymatic activity of (c) iminosuccinate reductase comprises an amino acid sequence selected from SEQ ID NO: 1-299;

and the polypeptide having the enzymatic activity of (d) aspartate-glyoxylate transaminase comprises an amino acid sequence selected from SEQ ID NO: 300-599.

In one embodiment, the method for the production of a transgenic plant with altered photorespiration and improved $CO_2$ fixation, comprises introducing into a cell or tissue of said plant one or more nucleic acids encoding at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the introduction of said nucleic acid(s) results in a de novo expression of the at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the polypeptide having the enzymatic activity of (c) iminosuccinate reductase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 1-299;

and the polypeptide having the enzymatic activity of (d) aspartate-glyoxylate transaminase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 300-599.

More in particular, the present invention is directed to a method for the production of a transgenic plant with altered photorespiration and improved $CO_2$ fixation, comprising introducing into a cell of said plant one or more nucleic acids encoding at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the introduction of said nucleic acid(s) results in a de novo expression of the at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;

and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599.

In alternative, the present invention is directed to a method for the production of a transgenic plant with altered photorespiration and improved $CO_2$ fixation, comprising introducing into a tissue of said plant one or more nucleic acids encoding four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the introduction of said nucleic acid(s) results in a de novo expression of the four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;

and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599.

In other words, the present invention is directed to a method for the production of a transgenic plant with altered photorespiration and improved $CO_2$ fixation, comprising introducing into a cell or tissue of said plant:
a nucleic acid sequence encoding a polypeptide having the enzymatic activity of a (a) erythro-β-hydroxyaspartate aldolase belonging to the EC class 4.1.3.14;
a nucleic acid sequence encoding a polypeptide having the enzymatic activity of a (b) erythro-β-hydroxyaspartate dehydratase belonging to the EC class 4.3.1.20;

a nucleic acid sequence encoding a polypeptide having the enzymatic activity of a (c) iminosuccinate reductase; and a nucleic acid sequence encoding a polypeptide having the enzymatic activity of a (d) aspartate-glyoxylate transaminase;

wherein the introduction of said nucleic acids results in a de novo expression of at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;

and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599.

In one embodiment, the method for the production of a transgenic plant with altered photorespiration and improved $CO_2$ fixation, comprises introducing into a cell or tissue of said plant one or more nucleic acids encoding at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the introduction of said nucleic acid(s) results in a de novo expression of the at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the polypeptide having the enzymatic activity of (c) iminosuccinate reductase comprises an amino acid sequence selected from SEQ ID NO: 1, 7, 22, 25, 26, 39, 47, 58, 75, 123, 135, and 160, or an amino acid sequence having at least 80% sequence identity to a sequence selected from SEQ ID NO: 1, 7, 22, 25, 26, 39, 47, 58, 75, 123, 135, and 160;

and the polypeptide having the enzymatic activity of (d) aspartate-glyoxylate transaminase comprises an amino acid sequence selected from SEQ ID NO: 300-599.

In one embodiment, the method for the production of a transgenic plant with altered photorespiration and improved $CO_2$ fixation, comprises introducing into a cell or tissue of said plant one or more nucleic acids encoding at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the introduction of said nucleic acid(s) results in a de novo expression of the at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the polypeptide having the enzymatic activity of (c) iminosuccinate reductase comprises an amino acid sequence selected from SEQ ID NO: 1, 7, 22, 25, 26, 39, 47, 58, 75, 123, 135, and 160, or an amino acid sequence having at least 80% sequence identity to a sequence selected from SEQ ID NO: 1, 7, 22, 25, 26, 39, 47, 58, 75, 123, 135, and 160;

and the polypeptide having the enzymatic activity of (d) aspartate-glyoxylate transaminase comprises an amino acid sequence selected from SEQ ID NO: 300-599.

In one embodiment, the method for the production of a transgenic plant with altered photorespiration and improved $CO_2$ fixation, comprises introducing into a cell or tissue of said plant one or more nucleic acids encoding at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the introduction of said nucleic acid(s) results in a de novo expression of the at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the polypeptide having the enzymatic activity of (c) iminosuccinate reductase comprises an amino acid sequence as set forth in SEQ ID NO: 135, or an amino acid sequence having at least 80% sequence identity to said sequence; and the polypeptide having the enzymatic activity of (d) aspartate-glyoxylate transaminase comprises an amino acid sequence as set forth in SEQ ID NO: 433, or an amino acid sequence having at least 80% sequence identity to said sequence.

In one embodiment, the method for the production of a transgenic plant with altered photorespiration and improved $CO_2$ fixation, comprises introducing into a cell or tissue of said plant one or more nucleic acids encoding at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the introduction of said nucleic acid(s) results in a de novo expression of the at least four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the polypeptide having the enzymatic activity of (c) iminosuccinate reductase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence as set forth in SEQ ID NO: 135;

and the polypeptide having the enzymatic activity of (d) aspartate-glyoxylate transaminase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence as set forth in SEQ ID NO: 433.

Preferably, in the inventive methods described herein, the de novo expressed polypeptide having the enzymatic activity of (a) erythro-β-hydroxyaspartate aldolase comprises an amino acid sequence having at least 80% sequence identity to SEQ ID NO: 953, the de novo expressed polypeptide having the enzymatic activity of (b) erythro-β-hydroxyaspartate dehydratase comprises an amino acid sequence having at least 80% sequence identity to SEQ ID NO: 954, the de novo expressed polypeptide having the enzymatic activity of (c) iminosuccinate reductase comprises an amino acid sequence having at least 80% sequence identity to a sequence selected from SEQ ID NO: 1-299, and the de novo expressed polypeptide having the enzymatic activity of (d) aspartate-glyoxylate transaminase comprises an amino acid sequence having at least 80% sequence identity to a sequence selected from SEQ ID NO: 300-599.

More preferably, in the inventive methods described herein, the de novo expressed polypeptide having the enzymatic activity of (a) erythro-β-hydroxyaspartate aldolase comprises an amino acid sequence having at least 90% sequence identity to SEQ ID NO: 953, the de novo expressed polypeptide having the enzymatic activity of (b) erythro-β-hydroxyaspartate dehydratase comprises an amino acid sequence having at least 90% sequence identity to SEQ ID NO: 954, the de novo expressed polypeptide having the enzymatic activity of (c) iminosuccinate reductase comprises an amino acid sequence having at least 90% sequence identity to a sequence selected from SEQ ID NO: 1-299, and the de novo expressed polypeptide having the enzymatic activity of (d) aspartate-glyoxylate transaminase comprises an amino acid sequence having at least 90% sequence identity to a sequence selected from SEQ ID NO: 300-599.

Even more preferably, in the inventive methods described herein, the de novo expressed polypeptide having the enzymatic activity of (a) erythro-β-hydroxyaspartate aldolase comprises an amino acid sequence having at least 95% sequence identity to SEQ ID NO: 953, the de novo expressed polypeptide having the enzymatic activity of (b) erythro-β-hydroxyaspartate dehydratase comprises an amino acid sequence having at least 95% sequence identity to SEQ ID NO: 954, the de novo expressed polypeptide having the enzymatic activity of (c) iminosuccinate reductase comprises an amino acid sequence having at least 95% sequence identity to a sequence selected from SEQ ID NO: 1-299, and the de novo expressed polypeptide having the enzymatic activity of (d) aspartate-glyoxylate transaminase comprises an amino acid sequence having at least 95% sequence identity to a sequence selected from SEQ ID NO: 300-599.

Even more preferably, in the inventive methods described herein, the de novo expressed polypeptide having the enzymatic activity of (a) erythro-β-hydroxyaspartate aldolase comprises an amino acid sequence having at least 97% sequence identity to SEQ ID NO: 953, the de novo expressed polypeptide having the enzymatic activity of (b) erythro-β-hydroxyaspartate dehydratase comprises an amino acid sequence having at least 97% sequence identity to SEQ ID NO: 954, the de novo expressed polypeptide having the enzymatic activity of (c) iminosuccinate reductase comprises an amino acid sequence having at least 97% sequence identity to a sequence selected from SEQ ID NO: 1-299, and the de novo expressed polypeptide having the enzymatic activity of (d) aspartate-glyoxylate transaminase comprises an amino acid sequence having at least 97% sequence identity to a sequence selected from SEQ ID NO: 300-599.

More preferably, in the inventive methods described herein, the de novo expressed polypeptide having the enzymatic activity of (a) erythro-β-hydroxyaspartate aldolase comprises an amino acid sequence having at least 99% sequence identity to SEQ ID NO: 953, the de novo expressed polypeptide having the enzymatic activity of (b) erythro-β-hydroxyaspartate dehydratase comprises an amino acid sequence having at least 99% sequence identity to SEQ ID NO: 954, the de novo expressed polypeptide having the enzymatic activity of (c) iminosuccinate reductase comprises an amino acid sequence having at least 99% sequence identity to a sequence selected from SEQ ID NO: 1-299, and the de novo expressed polypeptide having the enzymatic activity of (d) aspartate-glyoxylate transaminase comprises an amino acid sequence having at least 99% sequence identity to a sequence selected from SEQ ID NO: 300-599.

More preferably, in the inventive methods described herein, the de novo expressed polypeptide having the enzymatic activity of (a) erythro-β-hydroxyaspartate aldolase comprises the amino acid sequence SEQ ID NO: 953, the de novo expressed polypeptide having the enzymatic activity of (b) erythro-β-hydroxyaspartate dehydratase comprises the amino acid sequence SEQ ID NO: 954, the de novo expressed polypeptide having the enzymatic activity of (c) iminosuccinate reductase comprises the amino acid sequence selected from SEQ ID NO: 1-299, and the de novo expressed polypeptide having the enzymatic activity of (d) aspartate-glyoxylate transaminase comprises the amino acid sequence selected from SEQ ID NO: 300-599.

The β-hydroxyaspartate pathway (BHAP, FIG. 1) from *Paracoccus denitrificans* or other microorganisms can be implemented in different cellular compartments of a plant cell, such as peroxisomes, chloroplast, mitochondria and cytosol.

Therefore, one aspect of the invention is directed to a method for the production of a transgenic plant with altered photorespiration and improved $CO_2$ fixation, comprising introducing into a cell or tissue of said plant one or more nucleic acids encoding at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the introduction of said nucleic acid(s) results in a de novo expression of the at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599; and
wherein said polypeptides having the enzymatic activities (a)-(d) are localized in an cell organelle selected from peroxisomes, chloroplast, mitochondria and cytosol.

The BHAP implementation in plant peroxisomes shows some advantages compared to the other organelles. Indeed, photorespiration-derived glyoxylate is present at high concentration in peroxisomes. A second advantage of the BHAP implementation in peroxisomes is that the produced oxaloacetate or malate can thus be exported into the cytosol to enter gluconeogenesis or the TCA cycle anaplerotically without additional implementation of transport proteins. A third advantage is the small overlap between native metabolism in peroxisomes and the BHAP. Indeed, BHAP substrate and intermediate utilization by native peroxisomal metabolism is expected to be low. The before mentioned advantages of peroxisomal BHAP implementation suggests that peroxisomal implementation of the BHAP will have the strongest impact on plant growth.

Therefore, one embodiment of the invention is directed to a method for the production of a transgenic plant with altered photorespiration and improved $CO_2$ fixation, comprising introducing into a cell or tissue of said plant one or more nucleic acids encoding at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the introduction of said nucleic acid(s) results in a de novo expression of the at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599; and
wherein said polypeptides having the enzymatic activities (a)-(d) are localized in peroxisomes.

In order to target all four enzymes β-hydroxyaspartate aldolase (BHAA), β-hydroxyaspartate dehydratase (BHAD), iminosuccinate reductase (ISRed), and aspartate-glyoxylate aminotransferase (AsGAT) to plant peroxisomes, synthetic fusions with peroxisomal targeting sequences were generated. AsGAT, BHAD and ISRED were C-terminally fused with the three amino acid peroxisomal targeting signal 1 (PTS1; serine-lysine-leucine/SKL). C-terminal fusion of BHAA with PTS1 inactivated the enzyme and therefore, BHAA was N-terminally fused with the peroxisomal targeting signal 2 (PTS2; SEQ ID NO 951 (nucleic acid) and SEQ ID NO 952 (amino acid)) from *Arabidopsis* peroxisomal citrate synthase 3 (At2g42790). Thus, one embodiment of the invention is directed to a method for the production of a transgenic plant with altered photorespiration and improved $CO_2$ fixation, comprising introducing into a cell or tissue of said plant one or more nucleic acids encoding at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the introduction of said nucleic acid(s) results in a de novo expression of the four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599;
wherein said polypeptides having the enzymatic activities (a)-(d) comprise an amino acid sequence targeting said polypeptides to the peroxisomes,
wherein the (a) erythro-β-hydroxyaspartate aldolase belonging to the EC class 4.1.3.14 is C-terminally fused to a peroxisomal targeting signal 2 of SEQ ID NO: 952 and the polypeptides having the enzymatic activities (b)-(d) are N-terminally fused to a peroxisomal targeting signal 1 of amino acid sequence SKL.

It is to be understood that the de novo expressed polypeptides which were C-terminally or N-terminally fused to a target peptide may bear at the respective C-terminus or N-terminus the fused target peptide or other amino acid sequences, such as tags for immunoblot analysis.

Preferably, the de novo expressed (c) iminosuccinate reductase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 1-299.

More preferably, the polypeptide having the enzymatic activity of (c) iminosuccinate reductase comprises an amino acid sequence selected from SEQ ID NO: 1, 7, 22, 25, 26, 39, 47, 58, 75, 123, 135, and 160, or an amino acid sequence having at least 80% sequence identity to a sequence selected from SEQ ID NO: 1, 7, 22, 25, 26, 39, 47, 58, 75, 123, 135, and 160.

Preferably, the de novo expressed (d) aspartate-glyoxylate transaminase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 300-599.

More preferably, the polypeptide having the enzymatic activity of (c) iminosuccinate reductase comprises an amino acid sequence as set forth in SEQ ID NO: 135, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence; and the polypeptide having the enzymatic activity of (d) aspartate-glyoxylate transaminase comprises an amino acid sequence as set forth in SEQ ID NO: 433, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence.

The BHAP implementation in mitochondria and chloroplast requires additional engineering in comparison to the peroxisomes. As glyoxylate is low in chloroplasts and mitochondria, the establishing of the BHAP in these organelles requires the expression of glycolate dehydrogenase (EC 1.1.99.14) (enzymatic activity (e) for glyoxylate production).

In mitochondria, the oxaloacetate produced by the BHAP is directly metabolized by the TCA cycle, therefore establishing the BHAP in mitochondria requires de novo expression of the four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase, and (d) aspartate-glyoxylate transaminase, and further of one polypeptide having the enzymatic activity of (e) glycolate dehydrogenase belonging to the EC class 1.1.99.14.

Therefore, one embodiment of the present invention is directed to a method for the production of a transgenic plant with altered photorespiration and improved $CO_2$ fixation, comprising introducing into a cell or tissue of said plant one or more nucleic acids encoding at least five polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase,
(d) aspartate-glyoxylate transaminase, and
(e) glycolate dehydrogenase belonging to the EC class 1.1.99.14,
wherein the introduction of said nucleic acid(s) results in a de novo expression of the at least five polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase,
(d) aspartate-glyoxylate transaminase, and
(e) glycolate dehydrogenase belonging to the EC class 1.1.99.14,
wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599, and wherein said polypeptides having the enzymatic activities (a)-(e) are localized in mitochondria.

In order to target all five polypeptides having the enzymatic activities (a) erythro-β-hydroxyaspartate aldolase, (b) erythro-β-hydroxyaspartate dehydratase, (c) iminosuccinate reductase, (d) aspartate-glyoxylate transaminase, and (e) glycolate dehydrogenase to plant mitochondria they can be synthetically fused with mitochondria targeting sequences. In this way, the five polypeptides with the enzymatic activities (a)-(e) are fused to N-terminal targeting sequences such as that from *Arabidopsis* serine hydroxymethyltransferase 1 (At4g37930), having nucleic acid sequence and amino acid sequence of SEQ ID NO 918 and 919, respectively. Thus, one embodiment of the invention is directed to a method for the production of a transgenic plant with altered photorespiration and improved $CO_2$ fixation, comprising introducing into a cell or tissue of said plant one or more nucleic acids encoding at least five polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase,
(d) aspartate-glyoxylate transaminase, and
(e) glycolate dehydrogenase belonging to the EC class 1.1.99.14, wherein the introduction of said nucleic acid(s) results in a de novo expression of the at least five polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase
  (d) aspartate-glyoxylate transaminase, and
  (e) glycolate dehydrogenase belonging to the EC class 1.1.99.14,
wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599, and
wherein said polypeptides having the enzymatic activities (a)-(e) comprise an amino acid sequence targeting said polypeptides to the mitochondria.

In particular, one embodiment of the invention is directed to a method for the production of a transgenic plant with altered photorespiration and improved $CO_2$ fixation, comprising introducing into a cell or tissue of said plant one or more nucleic acids encoding at least five polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase
  (d) aspartate-glyoxylate transaminase, and
  (e) glycolate dehydrogenase belonging to the EC class 1.1.99.14,
wherein the introduction of said nucleic acid(s) results in a de novo expression of the at least five polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase,
  (d) aspartate-glyoxylate transaminase, and
  (e) glycolate dehydrogenase belonging to the EC class 1.1.99.14,
wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599,
wherein said polypeptides having the enzymatic activities (a)-(e) comprise an amino acid sequence targeting said polypeptides to the mitochondria, and
wherein said polypeptides having the enzymatic activities (a)-(e) are N-terminally fused to a serine hydroxymethyl-transferase 1 target peptide of SEQ ID NO: 919.

It is to be understood that the de novo expressed polypeptides which were N-terminally fused to a target peptide may bear at the respective N-terminus the fused target peptide or other amino acid sequences, such as tags for immunoblot analysis.

Preferably, the de novo expressed (c) iminosuccinate reductase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 1-299.

More preferably, the polypeptide having the enzymatic activity of (c) iminosuccinate reductase comprises an amino acid sequence selected from SEQ ID NO: 1, 7, 22, 25, 26, 39, 47, 58, 75, 123, 135, and 160, or an amino acid sequence having at least 80% sequence identity to a sequence selected from SEQ ID NO: 1, 7, 22, 25, 26, 39, 47, 58, 75, 123, 135, and 160.

Preferably, the de novo expressed (d) aspartate-glyoxylate transaminase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 300-599.

More preferably, the polypeptide having the enzymatic activity of (c) iminosuccinate reductase comprises an amino acid sequence as set forth in SEQ ID NO: 135, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence; and the polypeptide having the enzymatic activity of (d) aspartate-glyoxylate transaminase comprises an amino acid sequence as set forth in SEQ ID NO: 433, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence.

The BHAP implementation in chloroplasts requires, in addition to the further expression of the enzymatic activity (e) glycolate dehydrogenase, also an ATP-dependent phosphoenolpyruvate carboxykinase (PEPCK, EC 4.1.1.49) (enzymatic activity (f)) for downstream metabolism of oxaloacetate. Oxaloacetate produced by the BHAP will be decarboxylated by PEPCK and generated phosphoenolpyruvate will be converted into 2-phosphoglycerate by plastidial enolase, ENO1 (At1g74030) and further into 3-phosphoglycerate by plastidial phosphoglycerate mutase (PGM, At5g51820). Produced 3-phosphoglycerate subsequently enters photosynthetic carbon metabolism.

In view of the these considerations, establishing the BHAP in chloroplasts requires de novo expression of the four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase, and (d) aspartate-glyoxylate transaminase, and further of one polypeptide having the enzymatic activity of (e) glycolate dehydrogenase belonging to the EC class 1.1.99.14, and of one polypeptide having the enzymatic activity of (f) phosphoenolpyruvate carboxykinase belonging to the EC class 4.1.3.14.

Therefore, a further embodiment of the present invention is directed to a method for the production of a transgenic plant with altered photorespiration and improved $CO_2$ fixation, comprising introducing into a cell or tissue of said plant one or more nucleic acids encoding at least six polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase,
- (d) aspartate-glyoxylate transaminase,
- (e) glycolate dehydrogenase belonging to the EC class 1.1.99.14, and
- (f) phosphoenolpyruvate carboxykinase belonging to the EC class EC 4.1.1.49, wherein the introduction of said nucleic acid(s) results in a de novo expression of the at least six polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase,
- (d) aspartate-glyoxylate transaminase,
- (e) glycolate dehydrogenase belonging to the EC class 1.1.99.14, and
- (f) phosphoenolpyruvate carboxykinase belonging to the EC class EC 4.1.1.49, wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599,
and wherein said polypeptides having the enzymatic activities (a)-(f) are localized in chloroplasts.

In order to target all six polypeptides having the enzymatic activities (a) erythro-β-hydroxyaspartate aldolase, (b) erythro-β-hydroxyaspartate dehydratase, (c) iminosuccinate reductase, (d) aspartate-glyoxylate transaminase, (e) glycolate dehydrogenase, and (f) phosphoenolpyruvate carboxykinase to plant chloroplasts they can be synthetically fused with chloroplasts targeting sequences. In this way, the six polypeptides with the enzymatic activities (a)-(f) were fused to N-terminal targeting sequences such as that from *Arabidopsis* ferredoxin-2 (At1g60950), having nucleic acid sequence and amino acid sequence of SEQ ID NOs 916 and 917, respectively. Thus, one embodiment of the invention is directed to a method for the production of a transgenic plant with altered photorespiration and improved $CO_2$ fixation, comprising introducing into a cell or tissue of said plant one or more nucleic acids encoding at least six polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase,
- (d) aspartate-glyoxylate transaminase,
- (e) glycolate dehydrogenase belonging to the EC class 1.1.99.14, and
- (f) phosphoenolpyruvate carboxykinase belonging to the EC class EC 4.1.1.49, wherein the introduction of said nucleic acid(s) results in a de novo expression of the at least six polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase,
- (d) aspartate-glyoxylate transaminase,
- (e) glycolate dehydrogenase belonging to the EC class 1.1.99.14, and
- (f) phosphoenolpyruvate carboxykinase belonging to the EC class 4.1.1.49, wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599, and
wherein said polypeptides having the enzymatic activities (a)-(f) comprise an amino acid sequence targeting said polypeptides to the chloroplasts.

In particular, one embodiment of the invention is directed to a method for the production of a transgenic plant with altered photorespiration and improved $CO_2$ fixation, comprising introducing into a cell or tissue of said plant one or more nucleic acids encoding at least six polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase,
- (d) aspartate-glyoxylate transaminase, and
- (e) glycolate dehydrogenase belonging to the EC class 1.1.99.14, wherein the introduction of said nucleic acid(s) results in a de novo expression of the at least six polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase,
- (d) aspartate-glyoxylate transaminase, and
- (e) glycolate dehydrogenase belonging to the EC class 1.1.99.14, wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;

and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599,
wherein said polypeptides having the enzymatic activities (a)-(f) comprise an amino acid sequence targeting said polypeptides to the chloroplasts, and wherein said polypeptides having the enzymatic activities (a)-(f) are N-terminally fused to Arabidopsis Ferredoxin-2 chloroplastic target peptide of SEQ ID NO: 917.

It is to be understood that the de novo expressed polypeptides which were N-terminally fused to a target peptide may bear at the respective N-terminus the fused target peptide or other amino acid sequences, such as tags for immunoblot analysis.

Preferably, the de novo expressed (c) iminosuccinate reductase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 1-299.

More preferably, the polypeptide having the enzymatic activity of (c) iminosuccinate reductase comprises an amino acid sequence selected from SEQ ID NO: 1, 7, 22, 25, 26, 39, 47, 58, 75, 123, 135, and 160, or an amino acid sequence having at least 80% sequence identity to a sequence selected from SEQ ID NO: 1, 7, 22, 25, 26, 39, 47, 58, 75, 123, 135, and 160.

Preferably, the de novo expressed (d) aspartate-glyoxylate transaminase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 300-599.

More preferably, the polypeptide having the enzymatic activity of (c) iminosuccinate reductase comprises an amino acid sequence as set forth in SEQ ID NO: 135, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence; and the polypeptide having the enzymatic activity of (d) aspartate-glyoxylate transaminase comprises an amino acid sequence as set forth in SEQ ID NO: 433, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence.

Although the decarboxylation of oxaloacetate in the chloroplast might positively influence $CO_2$ assimilation, the PEPCK step requires one ATP per produced phosphoenolpyruvate, thereby weakening the energy-conserving principle of the BHAP. Furthermore, produced PEP might be distributed between 3-phosphoglycerate production and the shikimate pathway for aromatic amino acid biosynthesis. Alternatively, oxaloacetate is reduced by a NAD(P)-dependent malate dehydrogenase to produce malate that can be exported from the chloroplast via Dit1 (At5g12860). Although the first proposed strategy for BHAP expression in the chloroplast requires two more enzymes in addition to the BHAP core enzymes, the chloroplastic decarboxylation of oxaloacetate and the production of 3-phosphoglycerate that can directly enter photosynthetic carbon metabolism might be advantageous.

Moreover, the BHAP can be also implemented in plant cell cytosol. The localization of the four polypeptides having the enzymatic activities (a) erythro-β-hydroxyaspartate aldolase, (b) erythro-β-hydroxyaspartate dehydratase, (c) iminosuccinate reductase, and (d) aspartate-glyoxylate transaminase to plant cell cytosol does not require the presence of particular targeting sequences. Therefore, another embodiment of the invention is directed to a method for the production of a transgenic plant with altered photorespiration and improved $CO_2$ fixation, comprising introducing into a cell or tissue of said plant one or more nucleic acids encoding at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase,
wherein the introduction of said nucleic acid(s) results in a de novo expression of the at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase,
wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599, and
wherein said polypeptides having the enzymatic activities (a)-(d) are localized in cytosol.

In particular, another embodiment of the invention is directed to a method for the production of a transgenic plant with altered photorespiration and improved $CO_2$ fixation, comprising introducing into a cell or tissue of said plant one or more nucleic acids encoding at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the introduction of said nucleic acid(s) results in a de novo expression of the four polypeptides having the enzymatic activities of
- (a) erythro-β-hydroxyaspartate aldolase belonging to the EC class 4.1.3.14,
- (b) erythro-β-hydroxyaspartate dehydratase belonging to the EC class 4.3.1.20,
- (c) iminosuccinate reductase and
- (d) aspartate-glyoxylate transaminase, wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;

and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599, wherein said polypeptides having the enzymatic activities (a)-(d) are localized in cytosol; and wherein said polypeptides having the enzymatic activities (a)-(f) lack of a target sequence.

Preferably, the de novo expressed (c) iminosuccinate reductase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 1-299.

More preferably, the polypeptide having the enzymatic activity of (c) iminosuccinate reductase comprises an amino acid sequence selected from SEQ ID NO: 1, 7, 22, 25, 26, 39, 47, 58, 75, 123, 135, and 160, or an amino acid sequence having at least 80% sequence identity to a sequence selected from SEQ ID NO: 1, 7, 22, 25, 26, 39, 47, 58, 75, 123, 135, and 160.

Preferably, the de novo expressed (d) aspartate-glyoxylate transaminase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 300-599.

More preferably, the polypeptide having the enzymatic activity of (c) iminosuccinate reductase comprises an amino acid sequence as set forth in SEQ ID NO: 135, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence; and the polypeptide having the enzymatic activity of (d) aspartate-glyoxylate transaminase comprises an amino acid sequence as set forth in SEQ ID NO: 433, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence.

Codon Optimization

In designing the nucleic acid molecules of this invention for encoding four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase and (d) aspartate-glyoxylate transaminase, the nucleic acids from *Paracoccus denitrificans* or other Proteobacteria are modified in order to contain codons preferred by highly expressed plant genes in a procedure referred to as "codon optimization". Codon preferences for monocot and dicot plants have been taught by Murray et al., 1989, "Codon usage in plant genes", which characterized the codon usage (frequency of codon used for each amino acid except Met and Trp) in 207 plant gene sequences from 53 monocot and 154 dicot genes (Table 3, 4, 6, 7). Murray et al. showed that the relative use of synonymous codons differ between taxonomic groups, primarily in the use of G+C in the degenerate third base.

Moreover the patent EP0359472B1 describes in detail how to prepare a plant optimized sequence of the invention. In the synthetic nucleic acids, codons used to specify a given amino acid are selected on the basis of the distribution frequency of codon usage employed in highly expressed plant genes to specify that amino acid. In the synthetic genes, codons used to specify a given amino acid are selected with regard to the distribution frequency of codon usage employed in highly expressed plant genes to specify that amino acid. As is appreciated by those skilled in the art, the distribution frequency of codon usage utilized in the nucleic acid molecules is a determinant of the level of expression. Hence, the nucleic acid molecules are designed such that its distribution frequency of codon usage deviates, preferably, no more than 25% from that of highly expressed plant genes and, more preferably, no more than about 10%. In addition, consideration is given to the percentage G+C content of the degenerate third base (monocotyledons appear to favor G+C in this position, whereas dicotyledons do not). It is also recognized that the XCG nucleotide is the least preferred codon in dicots whereas the XTA codon is avoided in both monocots and dicots. Moreover, the nucleic acid sequence is modified to attain an A+T content in nucleotide base composition substantially that found in plants, and also to eliminate sequences that cause destabilization, inappropriate polyadenylation, degradation and termination of RNA and to avoid sequences that constitute secondary structure hairpins and RNA splice sites.

In the examples of the present invention, all four required genes of the BHAP were codon-optimized for expression in the respective plants, and in particular in cell peroxisomes, by gene synthesis (Sigma Aldrich, Germany). The examples disclosed herein show that the four enzymes were expressed in peroxisomes of *Nicotiana benthamiana* (*N. benthamiana*) (FIG. 2) and were functionally active in *N. benthamiana* leaf extracts (FIG. 3-8).

In one embodiment, the implemented genes of the BHAP were codon-optimized for expression in the respective plant. Thus, in one embodiment, the method for the production of a transgenic plant with altered photorespiration and improved $CO_2$ fixation, comprises introducing into a cell or tissue of said plant one or more codon-optimized nucleic acids encoding at least four polypeptides having the enzymatic activities of (a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the introduction of said nucleic acid(s) results in a de novo expression of the at least four polypeptides having the enzymatic activities of (a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;

and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599, and wherein said nucleic acid(s) are codon-optimized for expression in the transgenic plant.

In one embodiment, the implemented genes of the BHAP were codon-optimized for expression in *Arabidopsis thaliana*. Therefore when implementing the BHAP in *Arabidopsis* and in higher plants with similar codon usage, the nucleic acids encoding the polypeptides having the enzymatic activities of (a) erythro-β-hydroxyaspartate aldolase, (b) erythro-β-hydroxyaspartate dehydratase, (c) iminosuccinate reductase and (d) aspartate-glyoxylate transaminase are codon-optimized for expression in *Arabidopsis thaliana*. Thus, in one embodiment, the method for the production of a transgenic plant with altered photorespiration and improved $CO_2$ fixation, comprises introducing into a cell or tissue of said plant one or more nucleic acids encoding at least four polypeptides having the enzymatic activities of (a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the introduction of said nucleic acid(s) results in a de novo expression of the at least four polypeptides having the enzymatic activities of (a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;

and the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599, and wherein said nucleic acid(s) are codon-optimized for expression in *Arabidopsis thaliana*.

Preferably, the method for the production of a transgenic plant with altered photorespiration and improved $CO_2$ fixation, comprises introducing into a cell or tissue of said plant one or more nucleic acids encoding at least four polypeptides having the enzymatic activities of (a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the introduction of said nucleic acid(s) results in a de novo expression of the at least four polypeptides having the enzymatic activities of (a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the at least four polypeptides comprise an amino acid sequence as set forth in SEQ ID NO: 955-958, respectively, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequences.

Preferably, the nucleic acids encoding the polypeptides having the enzymatic activities of (a) erythro-β-hydroxyaspartate aldolase, (b) erythro-β-hydroxyaspartate dehydratase, (c) iminosuccinate reductase and (d) aspartate-glyoxylate transaminase comprise a polynucleotide sequence as set forth in SEQ ID NOs 959-962, respectively, or a polynucleotide sequence having at least 80% sequence identity to said sequences. Thus, in one embodiment, the method for the production of a transgenic plant with altered photorespiration and improved $CO_2$ fixation, comprises introducing into a cell or tissue of said plant one or more nucleic acids encoding at least four polypeptides having the enzymatic activities of (a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the introduction of said nucleic acid(s) results in a de novo expression of the at least four polypeptides having the enzymatic activities of (a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase, wherein the at least four polypeptides comprise an amino acid sequence as set forth in SEQ ID NOs: 953, 954, 135, and 433, respectively, and the nucleic acid(s) encoding the polypeptides having the enzymatic activities of (a) erythro-β-hydroxyaspartate aldolase, (b) erythro-β-hydroxyaspartate dehydratase, (c) iminosuccinate reductase and (d) aspartate-glyoxylate transaminase comprise a nucleic acid sequence as set forth in SEQ ID NOs 959-962, respectively; or wherein the at least four polypeptides comprise an amino acid sequence having at least 80% sequence identity to SEQ ID NOs: 953, 954, 135, and 433 respectively, and the nucleic acid(s) encoding the polypeptides having the enzymatic activities of (a) erythro-β-hydroxyaspartate aldolase, (b) erythro-β-hydroxyaspartate dehydratase, (c) iminosuccinate reductase and (d) aspartate-glyoxylate transaminase comprise a nucleic acid sequence having at least 80% sequence identity to SEQ ID NOs 959-962, respectively.

Alternatively, for the implementation of the BHAP in the cytosol, the nucleic acids encoding the polypeptides having the enzymatic activities of (a) erythro-β-hydroxyaspartate aldolase, (b) erythro-β-hydroxyaspartate dehydratase, (c) iminosuccinate reductase and (d) aspartate-glyoxylate transaminase comprise a polynucleotide sequence as set forth in SEQ ID NOs 963-966, respectively, or a polynucleotide sequence having at least 80% sequence identity to said sequences, respectively. Thus, in one embodiment, the method for the production of a transgenic plant with altered photorespiration and improved $CO_2$ fixation, comprises introducing into a cell or tissue of said plant one or more nucleic acids encoding at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the introduction of said nucleic acid(s) results in a de novo expression of the at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the at least four polypeptides comprise an amino acid sequence as set forth in SEQ ID NOs: 135, 433, 953 and 954, respectively, and the nucleic acid(s) encoding the polypeptides having the enzymatic activities of (a) erythro-β-hydroxyaspartate aldolase, (b) erythro-β-hydroxyaspartate dehydratase, (c) iminosuccinate reductase and (d) aspartate-glyoxylate transaminase comprise a nucleic acid sequence as set forth in SEQ ID NOs 963-966, respectively; or wherein the at least four polypeptides comprise an amino acid sequence having at least 80% sequence identity to SEQ ID NO: 135, 433, 953 and 954, respectively, and the nucleic acid(s) encoding the polypeptides having the enzymatic activities of (a) erythro-β-hydroxyaspartate aldolase, (b) erythro-β-hydroxyaspartate dehydratase, (c) iminosuccinate reductase and (d) aspartate-glyoxylate transaminase comprise a nucleic acid sequence having at least 80% sequence identity to SEQ ID NOs 963-966, respectively.

C3 Plants

The method of the present invention can be applied to any C3 plant, which fix and reduce inorganic $CO_2$ into organic compounds using only the C3 pathway in photosynthesis, including but not limited to *Helianthus annuus*, *Brassica napus*, *Camelina sativa*, *Oryza sativa*, *Hordeum vulgare*, *Triticum* spp., *Avena sativa*, *Solanum lycopersicum*, *Solanum tuberosum*, *Glycine max*, *Beta vulgaris*, *Nicotiana tabacum*, and *Arabidopsis thaliana*.

Thus, in one embodiment of the present invention, the method for the production of a transgenic plant with altered photorespiration and improved $CO_2$ fixation, comprises introducing into a cell or tissue of said plant one or more nucleic acids encoding at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the introduction of said nucleic acid(s) results in a de novo expression of the at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599,
and wherein the plant is a C3 plant.

Thus, in one embodiment of the present invention, the method for the production of a transgenic plant with altered photorespiration and improved $CO_2$ fixation, comprises introducing into a cell or tissue of said plant one or more nucleic acids encoding at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the introduction of said nucleic acid(s) results in a de novo expression of the at least four polypeptides having the enzymatic activities of
  (a) erythro-β-hydroxyaspartate aldolase belonging to the EC class 4.1.3.14,
  (b) erythro-β-hydroxyaspartate dehydratase belonging to the EC class 4.3.1.20,
  (c) iminosuccinate reductase and
  (d) aspartate-glyoxylate transaminase,
wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299; the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599,
and wherein the plant is selected from *Helianthus annuus*, *Brassica napus*, *Camelina sativa*, *Oryza sativa*, *Hordeum*

*vulgare, Triticum* spp., *Avena sativa, Solanum lycopersicum, Solanum tuberosum, Glycine max, Beta vulgaris, Nicotiana tabacum,* and *Arabidopsis thaliana*.

Moreover the present invention can be applied to other crop plants with C3 photosynthesis, such as *Artocarpus heterophyllus, Psidium guajava, Ocimum tenuiflorum, Citrus limon, Mangifera indica, Allium cepa, Pisum sativum, Solanum tuberosum, Tectona grandis, Ipomoea batatas, Psidium guajava, Secale cereale, Canavalia ensiformis, Medicago sativa* L., *Prunus* amygdalus L., *Phaseolus vulgaris* L., *Malus* spp., *Prunus armeniaca* L., *Asparagus officinalis* L., *Persea* american P.mill., *Musa sapientum* L., *Brassica oleracea* L., *Daucus carota* L., *Anacardium occidentale* L., *Cicer arietinum* L., *Theobroma cacao* L., *Vigna unguiculata, Vaccinium macrocarpon, Cucumis sativus* L., *Solanum melongena* L., *Vicia faba* L., *Ficus carica* L., *Linum usitatissimum* L., *Vitis vinifera* L., *Lactuca* spp., *Phaseolus lunatus* L., *Beta vulgaris* L., *Olea* europea L., *Citrus sinensis* L., *Petroselium* crispum, *Prunus persica* L., *Arachis hypogea* L., *Pyrus communis* L., *Carya illinoinensis, Capsicum* spp., *Cajanus cajan, Prunus* spp., *Gossypium hirsutum* L., *Ocimum tenuiflorum, Ricinus communis* L., and *Taraxacum officinale* Wigg.

Thus, in one embodiment of the present invention, the method for the production of a transgenic plant with altered photorespiration and improved $CO_2$ fixation, comprises introducing into a cell or tissue of said plant one or more nucleic acids encoding at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase,
wherein the introduction of said nucleic acid(s) results in a de novo expression of the at least four polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase and
(d) aspartate-glyoxylate transaminase,
wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599,
and wherein the plant is selected from *Helianthus annuus, Brassica napus, Camelina sativa, Oryza sativa, Hordeum vulgare, Triticum* spp., *Avena sativa, Solanum lycopersicum, Solanum tuberosum, Glycine max, Beta vulgaris, Nicotiana tabacum, Arabidopsis thaliana, Artocarpus heterophyllus, Psidium guajava, Ocimum tenuiflorum, Citrus limon, Mangifera indica, Allium cepa, Pisum sativum, Solanum tuberosum, Tectona grandis, Ipomoea batatas, Psidium guajava, Secale cereale, Canavalia ensiformis, Medicago sativa* L., *Prunus* amygdalus L., *Phaseolus vulgaris* L., *Malus* spp., *Prunus armeniaca* L., *Asparagus officinalis* L., *Persea* american P.mill., *Musa sapientum* L., *Brassica oleracea* L., *Daucus carota* L., *Anacardium occidentale* L., *Cicer arietinum* L., *Theobroma cacao* L., *Vigna unguiculata, Vaccinium macrocarpon, Cucumis sativus* L., *Solanum melongena* L., *Vicia faba* L., *Ficus carica* L., *Linum usitatissimum* L., *Vitis vinifera* L., *Lactuca* spp., *Phaseolus lunatus* L., *Beta vulgaris* L., *Olea* europea L., *Citrus sinensis* L., *Petroselium crispum, Prunus persica* L., *Arachis hypogea* L., *Pyrus communis* L., *Carya illinoinensis, Capsicum* spp., *Cajanus cajan, Prunus* spp., *Gossypium hirsutum* L., *Ocimum tenuiflorum, Ricinus communis* L., and *Taraxacum officinale*.

Preferably, in the inventive methods described above, the de novo expressed (c) iminosuccinate reductase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 1-299.

More preferably, the polypeptide having the enzymatic activity of (c) iminosuccinate reductase comprises an amino acid sequence selected from SEQ ID NO: 1, 7, 22, 25, 26, 39, 47, 58, 75, 123, 135, and 160, or an amino acid sequence having at least 80% sequence identity to a sequence selected from SEQ ID NO: 1, 7, 22, 25, 26, 39, 47, 58, 75, 123, 135, and 160.

Preferably, in the inventive methods described above, the de novo expressed (d) aspartate-glyoxylate transaminase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 300-599.

More preferably, in the inventive methods described above, the polypeptide having the enzymatic activity of (c) iminosuccinate reductase comprises an amino acid sequence as set forth in SEQ ID NO: 135, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence; and the polypeptide having the enzymatic activity of (d) aspartate-glyoxylate transaminase comprises an amino acid sequence as set forth in SEQ ID NO: 433, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence.

Preferably, in the inventive methods described above, the (a) erythro-β-hydroxyaspartate aldolase belonging to the EC class 4.1.3.14 is C-terminally fused to a peroxisomal targeting signal 2 of SEQ ID NO: 952 and the polypeptides having the enzymatic activities (b)-(d) are N-terminally fused to a peroxisomal targeting signal 1 of amino acid sequence SKL.

The inventors could also show that the expression of the enzymes of the BHAP can be induced by increasing intracellular levels of glyoxylate, which acts as an effector of the β-hydroxyaspartate regulatory protein. Therefore, the expression of the β-hydroxyaspartate regulatory protein (BHAR) allows for the specific induction of the BHAP in transgenic plants by increasing intracellular levels of glyoxylate. Thus in one embodiment of the present invention, the method for the production of a transgenic plant with altered photorespiration and improved $CO_2$ fixation, comprises introducing into a cell or tissue of said plant one or more nucleic acids encoding at least five polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase,
(d) aspartate-glyoxylate transaminase, and
(e) β-hydroxyaspartate regulatory protein,
wherein the introduction of the nucleic acid(s) results in a de novo expression of at least five polypeptides having the enzymatic activities of
(a) erythro-β-hydroxyaspartate aldolase belonging to the EC class 4.1.3.14,
(b) erythro-β-hydroxyaspartate dehydratase belonging to the EC class 4.3.1.20,
(c) iminosuccinate reductase,
(d) aspartate-glyoxylate transaminase, and
(e) β-hydroxyaspartate regulatory protein,
wherein the polypeptide having the enzymatic activity of (c) iminosuccinate reductase comprises an amino acid sequence selected from SEQ ID NO: 1-299, or an amino acid sequence having at least 80% sequence identity to a sequence selected from SEQ ID NO: 1-299;
wherein the polypeptide having the enzymatic activity of (d) aspartate-glyoxylate transaminase comprises an amino acid sequence selected from SEQ ID NO: 300-599, or an amino acid sequence having at least 80% sequence identity to a sequence selected from SEQ ID NO: 300-599; and
wherein the polypeptide having the enzymatic activity of (e) β-hydroxyaspartate regulatory protein comprises an amino acid sequence selected from SEQ ID NO: 600-899, or an amino acid sequence having at least 80% sequence identity to a sequence selected from SEQ ID NO: 600-899.

Preferably, the polypeptide having the enzymatic activity of (e) β-hydroxyaspartate regulatory protein comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99%% sequence identity to a sequence selected from SEQ ID NO: 600-899.

More preferably, the polypeptide having the enzymatic activity of (e) β-hydroxyaspartate regulatory protein comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99%% and most preferably at least 100% sequence identity to SEQ ID NO: 732.

Another aspect of the present invention is directed to a transgenic plant comprising one or more nucleic acids encoding at least four polypeptides having the enzymatic activities of (a) erythro-β-hydroxyaspartate aldolase, (b) erythro-β-hydroxyaspartate dehydratase, (c) iminosuccinate reductase, and (d) aspartate-glyoxylate transaminase. More in details, the present invention is directed to a transgenic plant comprising one or more heterologous nucleic acids encoding at least four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; and (d) aspartate-glyoxylate transaminase comprising an amino acid sequence selected from SEQ ID NO: 300-599, or an amino acid sequence having at least 80% sequence identity to a sequence selected from SEQ ID NO: 300-599.

More preferably, the inventive transgenic plant comprises one or more heterologous nucleic acids, which encode a polypeptide having the enzymatic activity of (a) erythro-β-hydroxyaspartate aldolase which comprises an amino acid sequence having at least 80% sequence identity to SEQ ID NO: 953, a polypeptide having the enzymatic activity of (b) erythro-β-hydroxyaspartate which comprises an amino acid sequence having at least 80% sequence identity SEQ ID NO: 954, a polypeptide having the enzymatic activity of (c) iminosuccinate reductase which comprises an amino acid sequence having at least 80% sequence identity to a sequence selected from SEQ ID NO: 1-299; and a polypeptide having the enzymatic activity of (d) aspartate-glyoxylate transaminase which comprises an amino acid sequence having at least 80% sequence identity to a sequence selected from SEQ ID NO: 300-599.

More preferably, the inventive transgenic plant comprises one or more heterologous nucleic acids, which encode a polypeptide having the enzymatic activity of (a) erythro-β-hydroxyaspartate aldolase which comprises an amino acid sequence having at least 90% sequence identity to SEQ ID NO: 953, a polypeptide having the enzymatic activity of (b) erythro-β-hydroxyaspartate which comprises an amino acid sequence having at least 90% sequence identity to SEQ ID NO: 954, a polypeptide having the enzymatic activity of (c) iminosuccinate reductase which comprises an amino acid sequence having at least 90% sequence identity to a sequence selected from SEQ ID NO: 1-299; and a polypeptide having the enzymatic activity of (d) aspartate-glyoxylate transaminase which comprises an amino acid sequence having at least 90% sequence identity to a sequence selected from SEQ ID NO: 300-599.

More preferably, the inventive transgenic plant comprises one or more heterologous nucleic acids, which encode a polypeptide having the enzymatic activity of (a) erythro-β-hydroxyaspartate aldolase which comprises an amino acid sequence having at least 95% sequence identity to SEQ ID NO: 953, a polypeptide having the enzymatic activity of (b) erythro-β-hydroxyaspartate which comprises an amino acid sequence having at least 95% sequence identity to SEQ ID NO: 954, a polypeptide having the enzymatic activity of (c) iminosuccinate reductase which comprises an amino acid sequence having at least 95% sequence identity to a sequence selected from SEQ ID NO: 1-299; and a polypeptide having the enzymatic activity of (d) aspartate-glyoxylate transaminase which comprises an amino acid sequence having at least 95% sequence identity to a sequence selected from SEQ ID NO: 300-599.

More preferably, the inventive transgenic plant comprises one or more heterologous nucleic acids, which encode a polypeptide having the enzymatic activity of (a) erythro-β-hydroxyaspartate aldolase which comprises an amino acid sequence having at least 97% sequence identity to SEQ ID NO: 953, a polypeptide having the enzymatic activity of (b) erythro-β-hydroxyaspartate which comprises an amino acid sequence having at least 97% sequence identity to SEQ ID NO: 954, a polypeptide having the enzymatic activity of (c) iminosuccinate reductase which comprises an amino acid sequence having at least 97% sequence identity to a sequence selected from SEQ ID NO: 1-299; and a polypeptide having the enzymatic activity of (d) aspartate-glyoxylate transaminase which comprises an amino acid sequence having at least 97% sequence identity to a sequence selected from SEQ ID NO: 300-599.

More preferably, the inventive transgenic plant comprises one or more heterologous nucleic acids, which encode a polypeptide having the enzymatic activity of (a) erythro-β-hydroxyaspartate aldolase which comprises an amino acid sequence having at least 99% sequence identity to SEQ ID NO: 953, a polypeptide having the enzymatic activity of (b) erythro-β-hydroxyaspartate which comprises an amino acid sequence having at least 99% sequence identity to SEQ ID NO: 954, a polypeptide having the enzymatic activity of (c) iminosuccinate reductase which comprises an amino acid sequence having at least 99% sequence identity to a sequence selected from SEQ ID NO: 1-299; and a polypeptide having the enzymatic activity of (d) aspartate-glyoxylate transaminase which comprises an amino acid sequence having at least 99% sequence identity to a sequence selected from SEQ ID NO: 300-599.

Still more preferably, the inventive transgenic plant comprises one or more heterologous nucleic acids, which encode a polypeptide having the enzymatic activity of (a) erythro-β-hydroxyaspartate aldolase which comprises an amino acid sequence of SEQ ID NO: 953, a polypeptide having the enzymatic activity of (b) erythro-β-hydroxyaspartate which comprises an amino acid sequence of SEQ ID NO: 954, a polypeptide having the enzymatic activity of (c) iminosuccinate reductase which comprises an amino acid sequence selected from SEQ ID NO: 1-299; and a polypeptide having the enzymatic activity of (d) aspartate-glyoxylate transaminase which comprises an amino acid sequence selected from SEQ ID NO: 300-599.

Within the context of the present invention, synthetic nucleic acids refer to nucleic acids which are of different natural or of synthetic origin, such as derived from another microorganism and then codon optimized for high expression in C3 plant.

Preferably, the transgenic plant of the present invention comprises one or more heterologous nucleic acids encoding at least four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; and (d) aspartate-glyoxylate transaminase comprising an amino acid sequence selected from SEQ ID NO: 300-599, or an amino acid sequence having at least 80% sequence identity to a sequence selected from SEQ ID NO: 300-599, wherein said polypeptides having the enzymatic activities (a)-(d) are localized in peroxisomes.

More preferably, the transgenic plant of the present invention comprises one or more heterologous nucleic acids encoding at least four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; and (d) aspartate-glyoxylate transaminase comprising an amino acid sequence selected from SEQ ID NO: 300-599, or an amino acid sequence having at least 80% sequence identity to a sequence selected from SEQ ID NO: 300-599,
wherein the polypeptides having the enzymatic activities (a)-(d) comprise an amino acid sequence targeting said polypeptides to the peroxisomes, and
wherein the (a) erythro-β-hydroxyaspartate aldolase belonging to the EC class 4.1.3.14 is C-terminally fused to a peroxisomal targeting signal 2 of SEQ ID NO: 952 and the polypeptides having the enzymatic activities (b)-(d) are N-terminally fused to a peroxisomal targeting signal 1 of amino acid sequence SKL.

In alternative, the transgenic plant of the present invention comprises one or more heterologous nucleic acids encoding at least five polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, and (e) glycolate dehydrogenase belonging to the EC class 1.1.99.14, wherein said polypeptides having the enzymatic activities (a)-(e) are localized in mitochondria.

More preferably, the transgenic plant of the present invention comprises one or more heterologous nucleic acids encoding at least five polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, and (e) glycolate dehydrogenase belonging to the EC class 1.1.99.14, wherein said polypeptides having the enzymatic activities (a)-(e) are localized in mitochondria, and wherein said polypeptides having the enzymatic activities (a)-(e) are N-terminally fused to a serine hydroxymethyltransferase 1 target peptide of SEQ ID NO: 919.

In another aspect, the transgenic plant of the present invention comprises one or more heterologous nucleic acids encoding at least six polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, (e) glycolate dehydrogenase belonging to the EC class 1.1.99.14, and (f) phosphoenolpyruvate carboxykinase belonging to the EC class 4.1.3.14, wherein said polypeptides having the enzymatic activities (a)-(f) are localized in chloroplasts.

More preferably, the transgenic plant of the present invention comprises one or more heterologous nucleic acids encoding at least six polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, (e) glycolate dehydrogenase belonging to the EC class 1.1.99.14, and (f) phosphoenolpyruvate carboxykinase belonging to the EC class 4.1.3.14, wherein said polypeptides having the enzymatic activities (a)-(f) are localized in chloroplasts, and wherein said polypeptides having the enzymatic activities (a)-(f) are N-terminally fused to *Arabidopsis* Ferredoxin-2 chloroplastic target peptide of SEQ ID NO: 917.

Preferably, in inventive transgenic plants described herein, the de novo expressed (c) iminosuccinate reductase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 1-299.

More preferably, the polypeptide having the enzymatic activity of (c) iminosuccinate reductase comprises an amino acid sequence selected from SEQ ID NO: 1, 7, 22, 25, 26, 39, 47, 58, 75, 123, 135, and 160, or an amino acid sequence having at least 80% sequence identity to a sequence selected from SEQ ID NO: 1, 7, 22, 25, 26, 39, 47, 58, 75, 123, 135, and 160.

Preferably, in inventive transgenic plants described herein, the de novo expressed (d) aspartate-glyoxylate transaminase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 300-599.

More preferably, in inventive transgenic plants described herein, the polypeptide having the enzymatic activity of (c) iminosuccinate reductase comprises an amino acid sequence as set forth in SEQ ID NO: 135, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence; and the polypeptide having the enzymatic activity of (d) aspartate-glyoxylate transaminase comprises an amino acid sequence as set forth in SEQ ID NO: 433, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence.

The transgenic plant can be any C3 plant, including but not limited to *Helianthus annuus, Brassica napus, Camelina sativa, Oryza sativa, Hordeum vulgare, Triticum* spp., *Avena sativa, Solanum lycopersicum, Solanum tuberosum, Glycine max, Beta vulgaris, Nicotiana tabacum*, and *Arabidopsis thaliana*.

Therefore, one embodiment of the present invention is directed to a transgenic plant comprising one or more heterologous nucleic acids encoding at least four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; and (d) aspartate-glyoxylate transaminase comprising an amino acid sequence selected from SEQ ID NO: 300-599, or an amino acid sequence having at least 80% sequence identity to a sequence selected from SEQ ID NO: 300-599, wherein the plant is a C3 plant.

One embodiment of the present invention is directed to a transgenic plant comprising one or more heterologous nucleic acids encoding at least four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; and (d) aspartate-glyoxylate transaminase comprising an amino acid sequence selected from SEQ ID NO: 300-599, or an amino acid sequence having at least 80% sequence identity to a sequence selected from SEQ ID NO: 300-599, wherein the plant is selected from *Helianthus annuus, Brassica napus, Camelina sativa, Oryza sativa, Hordeum vulgare, Triticum* spp., *Avena sativa, Solanum lycopersicum, Solanum tuberosum, Glycine max, Beta vulgaris, Nicotiana tabacum*, and *Arabidopsis thaliana*.

Moreover, one embodiment of the present invention is directed to a transgenic plant comprising one or more heterologous nucleic acids encoding at least four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; and (d) aspartate-glyoxylate transaminase comprising an amino acid sequence selected from SEQ ID NO: 300-599, or an amino acid sequence having at least 80% sequence identity to a sequence selected from SEQ ID NO: 300-599, wherein said polypeptides having the enzymatic activities (a)-(d) are localized in peroxisomes, and wherein the plant is a C3 plant.

One embodiment of the present invention is directed to a transgenic plant comprising one or more heterologous nucleic acids encoding four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; and (d) aspartate-glyoxylate transaminase comprising an amino acid sequence selected from SEQ ID NO: 300-599, or an amino acid sequence having at least 80% sequence identity to a sequence selected from SEQ ID NO: 300-599, wherein said polypeptides having the enzymatic activities (a)-(d) are localized in peroxisomes, and wherein the plant is selected from *Helianthus annuus, Brassica napus, Camelina sativa, Oryza sativa, Hordeum vulgare, Triticum* spp., *Avena sativa, Solanum lycopersicum, Solanum tuberosum, Glycine max, Beta vulgaris, Nicotiana tabacum*, and *Arabidopsis thaliana*.

In an alternative embodiment, the transgenic plant of the present invention comprises one or more heterologous nucleic acids encoding at least five polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, and (e) glycolate dehydrogenase belonging to the EC class 1.1.99.14, wherein said polypeptides having the enzymatic activities (a)-(e) are localized in mitochondria, and wherein the plant is a C3 plant.

Also, the transgenic plant of the present invention comprises one or more heterologous nucleic acids encoding at least five polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, and (e) glycolate dehydrogenase belonging to the EC class 1.1.99.14, wherein said polypeptides having the enzymatic activities (a)-(e) are localized in mitochondria, and wherein the plant is selected from *Helianthus annuus, Brassica napus, Camelina sativa, Oryza sativa, Hordeum vulgare, Triticum* spp., *Avena sativa, Solanum lycopersicum, Solanum tuberosum, Glycine max, Beta vulgaris, Nicotiana tabacum*, and *Arabidopsis thaliana*.

In another aspect, the transgenic plant of the present invention comprises one or more heterologous nucleic acids encoding at least six polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, (e) glycolate dehydrogenase belonging to the EC class 1.1.99.14, and (f) phosphoenolpyruvate carboxykinase belonging to the EC class 4.1.3.14, wherein said polypeptides having the enzymatic activities (a)-(f) are localized in chloroplasts, and wherein the plant is a C3 plant.

In another aspect, the transgenic plant of the present invention comprises one or more heterologous nucleic acids encoding at least six polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, (e) glycolate dehydrogenase belonging to the EC class 1.1.99.14, and (f) phosphoenolpyruvate carboxykinase belonging to the EC class 4.1.3.14, wherein said polypeptides having the enzymatic activities (a)-(f) are localized in chloroplasts, and wherein the plant is selected from *Helianthus annuus, Brassica napus, Camelina sativa, Oryza sativa, Hordeum vulgare, Triticum* spp., *Avena sativa, Solanum lycopersicum, Solanum tuberosum, Glycine max, Beta vulgaris, Nicotiana tabacum*, and *Arabidopsis thaliana*.

Moreover the present invention can be applied to other crop plants with C3 photosynthesis, such as *Artocarpus heterophyllus, Psidium guajava, Ocimum tenuiflorum, Citrus limon, Mangifera indica, Allium cepa, Pisum sativum, Solanum tuberosum, Tectona grandis, Ipomoea batatas, Psidium guajava, Secale cereale, Canavalia ensiformis, Medicago sativa* L., *Prunus amygdalus* L., *Phaseolus vulgaris* L., *Malus* spp., *Prunus armeniaca* L., *Asparagus officinalis* L., *Persea american* P.mill., *Musa sapientum* L., *Brassica oleracea* L., *Daucus carota* L., *Anacardium occidentale* L., *Cicer arietinum* L., *Theobroma cacao* L., *Vigna unguiculata, Vaccinium macrocarpon, Cucumis sativus* L., *Solanum melongena* L., *Vicia faba* L., *Ficus carica* L., *Linum usitatissimum* L., *Vitis vinifera* L., *Lactuca* spp., *Phaseolus lunatus* L., *Beta vulgaris* L., *Olea europea* L., *Citrus sinensis* L., *Petroselium crispum, Prunus persica* L., *Arachis hypogea* L., *Pyrus communis* L., *Carya illinoinensis, Capsicum* spp., *Cajanus cajan, Prunus* spp., *Gossypium hirsutum* L., *Ocimum* tenuiflorum, *Ricinus communis* L., and *Taraxacum officinale* Wigg.

Preferably, in inventive transgenic C3 plants described herein, the de novo expressed (c) iminosuccinate reductase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 1-299.

More preferably, the polypeptide having the enzymatic activity of (c) iminosuccinate reductase comprises an amino acid sequence selected from SEQ ID NO: 1, 7, 22, 25, 26, 39, 47, 58, 75, 123, 135, and 160, or an amino acid sequence having at least 80% sequence identity to a sequence selected from SEQ ID NO: 1, 7, 22, 25, 26, 39, 47, 58, 75, 123, 135, and 160.

Preferably, in inventive transgenic C3 plants described herein, the de novo expressed (d) aspartate-glyoxylate transaminase comprises an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 300-599.

More preferably, in inventive transgenic C3 plants described herein, the polypeptide having the enzymatic activity of (c) iminosuccinate reductase comprises an amino acid sequence as set forth in SEQ ID NO: 135, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence; and the polypeptide having the enzymatic activity of (d) aspartate-glyoxylate transaminase comprises an amino acid sequence as set forth in SEQ ID NO: 433, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence.

Moreover, the inventors have designed a nucleic acid construct for implementation of the four polypeptides of BHAP in plants (FIG. 9). Within the multigene construct each BHAP enzyme is expressed under its own photosynthetically regulated promoter, restricting BHAP expression to photosynthetic tissue and coupling BHAP expression to light and high photorespiratory metabolic flux. In particular, the nucleic acid construct comprises the nucleic acid sequence coding the polypeptide having the enzymatic activity BHAA under the *Arabidopsis* RubisCO small subunit 2B promoter (AtRbcS2Bp, AT5g38420), the nucleic acid sequence coding the polypeptide having the enzymatic activity BHAD is expressed under the *Arabidopsis* RubisCO small subunit 1B promoter (AtRbcS1 Bp, AT5g38430), the nucleic acid sequence coding the polypeptide having the enzymatic activity ISRed expressed under the *Arabidopsis* RubisCO small subunit 3B promoter (AtRbS3Bp, AT5g38410), and the nucleic acid sequence coding the polypeptide having the enzymatic activity AsGAT expressed under *Arabidopsis* chlorophyll A binding protein promoter (AtCaBp, AT1g29930). Moreover, the nucleic acid construct comprises terminator sequences operably linked to the nucleic acid sequence coding each polypeptide. These terminators are: *Agrobacterium tumefaciens* octopine synthase terminator (AtuOCSt), *Agrobacterium tumefaciens* nopaline synthase terminator (AtuNOSt), 35S terminator derived from the Cauliflower Mosaic Virus (35St), *Solanum lycopersicum* RubisCO small subunit 3C terminator (SlRbcS3Ct). Kanamycin resistance is used as selection marker.

Functionality of this nucleic acid construct regarding expression of all four enzymes was verified by transient expression in *N. benthamiana*, followed by immunoblot analysis (FIG. 10-11).

Moreover *Arabidopsis* wildtype Col-0 and ggt1 mutant (GK-649H07) were transformed with the generated BHAP nucleic acid construct by floral dipping. The ggt1 mutant is deficient in the peroxisomal glyoxylate:glutamate aminotransferase 1 (GGT1, At1g23310) and accumulates glyoxylate (see Dellero et. al, Plant J. 83, 1005-1018 (2015)). The inventors verified complete BHAP implementation in *Arabidopsis* WT and ggt1 mutant by genotyping using for each BHAP enzyme a combination forward and reverse primers specific for the promoter and the coding sequence of interest (FIG. 16). The established transgenic lines with the BHAP in WT and ggt1 mutant background are analyzed for protein expression and enzymatic activity of all four BHAP enzymes to identify primary transformants with high BHAP activity. Therefore, BHAP enzymes are individually assayed in vitro and complete BHAP activity is tested.

Thus, another aspect of the present invention is directed to a nucleic acid construct comprising nucleic acid sequences encoding at least four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, wherein said nucleic acid sequences are operably linked to at least one promoter for expression in a plant. Preferably, the nucleic acid sequences are further operably linked to at least one terminator.

"Operably linked" is intended to mean a functional linkage between two or more elements. For example, an operable linkage between a polynucleotide of interest and a regulatory sequence (i.e., a promoter) is a functional link that allows for expression of the polynucleotide of interest. Operably linked elements may be contiguous or non-contiguous. When used to refer to the joining of two protein coding regions, by operably linked is intended that the coding regions are in the same reading frame. A nucleic acid is "operably linked" when it is placed into a functional relationship with another nucleic acid sequence. In particular, by "operably linked" is meant that a gene and a regulatory sequence(s) are connected in such a way as to permit gene expression when the appropriate molecules (e.g., transcriptional activator proteins) are bound to the regulatory sequence(s). For example, DNA for a presequence or secretory leader is operably linked to DNA for a polypeptide if it is expressed as a preprotein that participates in the secretion of the polypeptide; a promoter or enhancer or terminator is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and present in open reading frame. However, enhancers do not have to be contiguous. Linking is accomplished by ligation at convenient restriction sites. If such sites do not exist, the synthetic oligonucleotide adaptors or linkers are used in accordance with conventional practice.

Preferably, the promoter is a photosynthetically regulated promoter, such as *Arabidopsis* chlorophyll A binding protein promoter (AT1g29930), *Arabidopsis* RubisCO small subunit 2B promoter (AT5g38420), *Arabidopsis* RubisCO small subunit 1B promoter (AT5g38430), or *Arabidopsis* RubisCO small subunit 3B promoter (AT5g38410), thereby restricting expression of the BHAP enzymes to photosynthetic tissue and coupling the expression of said enzymes to light and high photorespiratory metabolic flux.

Therefore, one embodiment of the present invention is directed to a nucleic acid construct comprising nucleic acid sequences encoding four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, wherein said nucleic acid sequences are operably linked to at least one photosynthetically regulated promoter for expression in a plant. Preferably, the photosynthetically regulated promoter is selected from *Arabidopsis* chlorophyll A binding protein promoter (AT1g29930), *Arabidopsis* RubisCO small subunit 2B promoter (AT5g38420), *Arabidopsis* RubisCO small subunit 1B promoter (AT5g38430), and *Arabidopsis* RubisCO small subunit 3B promoter (AT5g38410).

In one embodiment of the present invention the nucleic acid construct comprises nucleic acid sequences encoding at least four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, wherein said nucleic acid sequences are operably linked to at least one photosynthetically regulated promoter for expression in a plant and are operably linked to at least one terminator.

In a further embodiment of the present invention the nucleic acid construct comprises nucleic acid sequences encoding at least four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, a selection marker nucleic acid, wherein said nucleic acid sequences are operably linked to at least one photosynthetically regulated promoter for expression in a plant and are operably linked to at least one terminator. Preferably, the selection marker nucleic acid is a kanamycin resistance nucleic acid. Preferably, the kanamycin resistance nucleic acid comprises a nucleic acid sequence as included in SEQ ID NO: 986 (nucleotides 9581-11438).

Preferably, in the inventive nucleic acid constructs described herein, the nucleic acid sequences encode an (c) iminosuccinate reductase comprising an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 1-299.

More preferably, the nucleic acid sequences encode an (c) iminosuccinate reductase comprising an amino acid sequence selected from SEQ ID NO: 1, 7, 22, 25, 26, 39, 47, 58, 75, 123, 135, and 160, or an amino acid sequence having at least 80% sequence identity to a sequence selected from SEQ ID NO: 1, 7, 22, 25, 26, 39, 47, 58, 75, 123, 135, and 160.

Preferably, in the inventive nucleic acid constructs described herein, the nucleic acid sequences encode an (d) aspartate-glyoxylate transaminase comprising an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to a sequence selected from SEQ ID NO: 300-599.

More preferably, in the inventive nucleic acid constructs described herein, the nucleic acid sequences encode an (c) iminosuccinate reductase comprising an amino acid sequence as set forth in SEQ ID NO: 135, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence; and the the nucleic acid sequences encode an (d) aspartate-glyoxylate transaminase comprising an amino acid sequence as set forth in SEQ ID NO: 433, or an amino acid sequence having at least 80%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence.

In one embodiment of the present invention, the nucleic acid construct comprises (1) a nucleic acid sequence comprising a sequence as set forth in SEQ ID NO: 963 which encodes a polypeptide having the enzymatic activity of erythro-β-hydroxyaspartate aldolase belonging to the EC class 4.1.3.14, (2) a nucleic acid sequence comprising a sequence as set forth in SEQ ID NO: 964, which encodes a polypeptide having the enzymatic activity of erythro-β-hydroxyaspartate dehydratase belonging to the EC class 4.3.1.20, (3) a nucleic acid sequence comprising a sequence as set forth in SEQ ID NO: 965, which encodes a polypeptide having the enzymatic activity of iminosuccinate reductase, and (4) a nucleic acid sequence comprising a sequence as set forth in SEQ ID NO: 966, which encodes a polypeptide having the enzymatic activity of aspartate-glyoxylate transaminase, wherein the nucleic acid sequences (1)-(4) are operably linked to at least one photosynthetically regulated promoter for expression in a plant.

Preferably, the nucleic acid construct comprises (1) a nucleic acid sequence comprising a sequence as set forth in SEQ ID NO: 963, which encodes a polypeptide having the enzymatic activity of erythro-β-hydroxyaspartate aldolase belonging to the EC class 4.1.3.14, (2) a nucleic acid sequence comprising a sequence as set forth in SEQ ID NO: 964, which encodes a polypeptide having the enzymatic activity of erythro-β-hydroxyaspartate dehydratase belonging to the EC class 4.3.1.20, (3) a nucleic acid sequence comprising a sequence as set forth in SEQ ID NO: 965, which encodes a polypeptide having the enzymatic activity of iminosuccinate reductase, and (4) a nucleic acid sequence comprising a sequence as set forth in SEQ ID NO: 966, which encodes a polypeptide having the enzymatic activity of aspartate-glyoxylate transaminase, wherein the nucleic acid sequences (1)-(4) are operably linked to at least one photosynthetically regulated promoter for expression in a plant and are operably linked to at least one terminator.

Preferably, the nucleic acid construct comprises (1) a nucleic acid sequence comprising a sequence as set forth in SEQ ID NO: 963, which encodes a polypeptide having the enzymatic activity of erythro-β-hydroxyaspartate aldolase belonging to the EC class 4.1.3.14, (2) a nucleic acid sequence comprising a sequence as set forth in SEQ ID NO: 964, which encodes a polypeptide having the enzymatic activity of erythro-β-hydroxyaspartate dehydratase belonging to the EC class 4.3.1.20, (3) a nucleic acid sequence comprising a sequence as set forth in SEQ ID NO: 965, which encodes a polypeptide having the enzymatic activity of iminosuccinate reductase, and (4) a nucleic acid sequence comprising a sequence as set forth in SEQ ID NO: 966, which encodes a polypeptide having the enzymatic activity of aspartate-glyoxylate transaminase, (5) a selection marker nucleic acid, wherein the nucleic acid sequences (1)-(5) are operably linked to at least one photosynthetically regulated promoter for expression in a plant and are operably linked to at least one terminator. Preferably, the selection marker nucleic acid is a kanamycin resistance nucleic acid.

Preferably, the kanamycin resistance nucleic acid comprises a nucleic acid sequence as included in SEQ ID NO: 986 (nucleotides 9581-11438).

More preferably, the nucleic acid construct comprises (1) a nucleic acid sequence comprising a sequence as set forth in SEQ ID NO: 963, which encodes a polypeptide having the enzymatic activity of erythro-β-hydroxyaspartate aldolase belonging to the EC class 4.1.3.14, (2) a nucleic acid sequence comprising a sequence as set forth in SEQ ID NO: 964, which encodes a polypeptide having the enzymatic activity of erythro-β-hydroxyaspartate dehydratase belonging to the EC class 4.3.1.20, (3) a nucleic acid sequence comprising a sequence as set forth in SEQ ID NO: 965, which encodes a polypeptide having the enzymatic activity of iminosuccinate reductase, and (4) a nucleic acid sequence comprising a sequence as set forth in SEQ ID NO: 966, which encodes a polypeptide having the enzymatic activity of aspartate-glyoxylate transaminase, (5) a kanamycin resistance nucleic acid, wherein the nucleic acid sequences (1)-(5) are operably linked to at least one photosynthetically regulated promoter for expression in a plant and are operably linked to at least one terminator. Preferably, the kanamycin resistance nucleic acid comprises a nucleic acid sequence as included in SEQ ID NO: 986 (nucleotides 9581-11438).

In one embodiment of the present invention, the nucleic acid construct comprises nucleic acid sequences encoding four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, a further nucleic acid sequence targeting said polypeptides to the peroxisomes, and wherein said nucleic acid sequences are operably linked to at least one photosynthetically regulated promoter for expression in a plant.

Preferably, the nucleic acid construct comprises nucleic acid sequences encoding four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, a further nucleic acid sequence targeting said polypeptides to the peroxisomes, and wherein said nucleic acid sequences are operably linked to at least one photosynthetically regulated promoter for expression in a plant and are operably linked to at least one terminator.

Preferably, the nucleic acid construct comprises nucleic acid sequences encoding four polypeptides having the enzymatic activities of (a) erythro-β-hydroxyaspartate aldolase belonging to the EC class 4.1.3.14, (b) erythro-β-hydroxyaspartate dehydratase belonging to the EC class 4.3.1.20, (c) iminosuccinate reductase comprising an amino acid sequence selected from SEQ ID NO: 1-299, or an amino acid sequence having at least 80% sequence identity to a sequence selected from SEQ ID NO: 1-299; (d) aspartate-glyoxylate transaminase comprising an amino acid sequence selected from SEQ ID NO: 300-599, or an amino acid sequence having at least 80% sequence identity to a sequence selected from SEQ ID NO: 300-599, a selection marker nucleic acid, a further nucleic acid sequence targeting said polypeptides to the peroxisomes, and wherein said nucleic acid sequences are operably linked to at least one photosynthetically regulated promoter for expression in a plant and are operably linked to at least one terminator. Preferably, the selection marker nucleic acid is a kanamycin resistance nucleic acid.

In one embodiment of the present invention, the nucleic acid construct comprises (1) a nucleic acid sequence comprising a sequence as set forth in SEQ ID NO: 960, which encodes a polypeptide having the enzymatic activity of erythro-β-hydroxyaspartate aldolase belonging to the EC class 4.1.3.14, (2) a nucleic acid sequence comprising a sequence as set forth in SEQ ID NO: 961, which encodes a polypeptide having the enzymatic activity of erythro-β-hydroxyaspartate dehydratase belonging to the EC class 4.3.1.20, (3) a nucleic acid sequence comprising a sequence as set forth in SEQ ID NO: 959, which encodes a polypeptide having the enzymatic activity of iminosuccinate reductase, and (4) a nucleic acid sequence comprising a sequence as set forth in SEQ ID NO: 962, which encodes a polypeptide having the enzymatic activity of aspartate-glyoxylate transaminase, wherein the nucleic acid sequences (1)-(4) are operably linked to at least one photosynthetically regulated promoter for expression in a plant and are operably linked to at least one terminator.

In a preferred embodiment of the present invention, the nucleic acid construct comprises a nucleic acid sequence as set forth in SEQ ID NO: 986, or a nucleic acid sequence having at least 80%%, more preferably at least 85%, more preferably at least 87%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98% and most preferably at least 99% sequence identity to said sequence.

Figure 1:
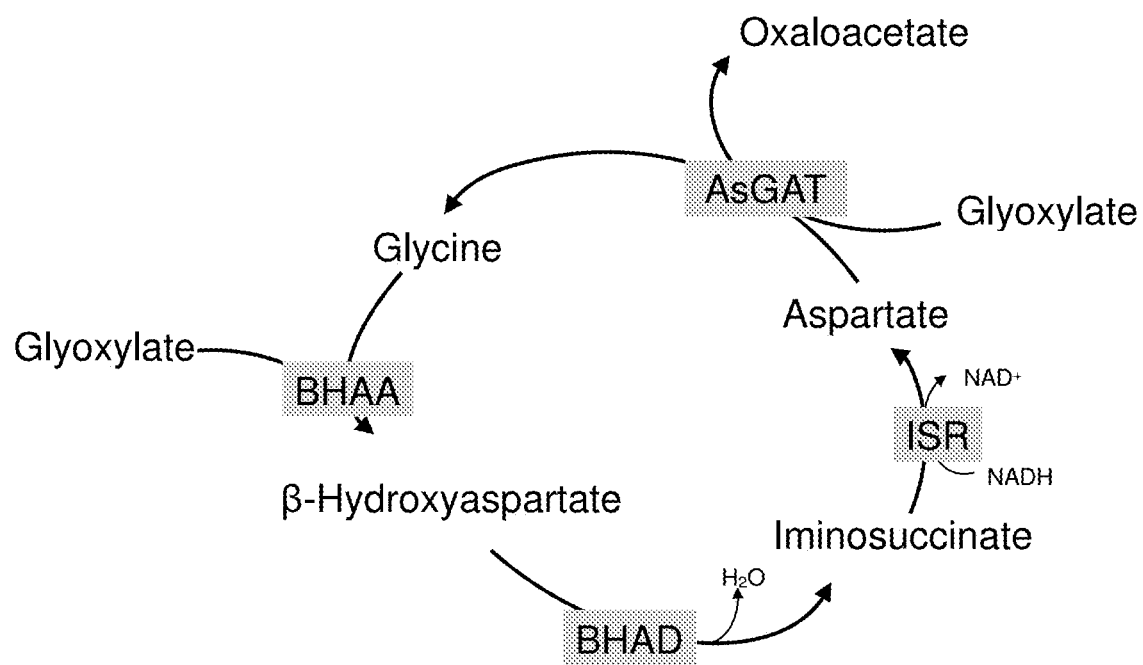
FIG. 1: illustrates the integration of the BHAP as $CO_2$ neutral photorespiratory bypass, the reaction sequence of the β-hydroxyaspartate pathway (as recently elucidated by the inventors), the core sequence of the projected carbon-neutral photorespiration bypass route. Enzymes are indicated in grey boxes aspartate-glyoxylate transaminase (AsGAT), β-hydroxyaspartate aldolase (BHAA), β-hydroxyaspartate dehydratase (BHAD), iminosuccinate reductase (ISRed).

The following examples are included to demonstrate preferred embodiments of the invention. It should be appreciated by those of skill in the art that the techniques disclosed in the examples which follow represent techniques discovered by the inventor to function well in the practice of the invention, and thus can be considered to constitute preferred modes for its practice. However, those of skill in the art should, in light of the present disclosure, appreciate that many changes can be made in the specific embodiments which are disclosed and still obtain a like or similar result without departing from the spirit and scope of the invention.

Further modifications and alternative embodiments of various aspects of the invention will be apparent to those skilled in the art in view of this description. Accordingly, this description is to be construed as illustrative only and is for the purpose of teaching those skilled in the art the general manner of carrying out the invention. It is to be understood that the forms of the invention shown and described herein are to be taken as examples of embodiments. Elements and materials may be substituted for those illustrated and described herein, parts and processes may be reversed, and certain features of the invention may be utilized independently, all as would be apparent to one skilled in the art after having the benefit of this description of the invention. Changes may be made in the elements described herein without departing from the spirit and scope of the invention as described in the following claims.

EXAMPLES

Abbreviations and Acronyms

AsGAT, AGAT aspartate glyoxylate aminotransferase
ISRed, ISR iminosuccinate reductase
BHA erythro-β-hydroxyaspartate
BHAA β-hydroxyaspartate aldolase
BHAD β-hydroxyaspartate dehydratase
BHAP β-hydroxyaspartate pathway
CBB Calvin-Benson-Bassham
DNA desoxyribo nucleic acid
fwd forward primer FDH formate dehydrogenase
MDH malate dehydrogenase
rev reverse primer Chemicals & Reagents Unless otherwise stated, all chemicals and reagents were acquired from Sigma-Aldrich and were of the highest purity available. Gene synthesis was also performed by Sigma-Aldrich.

Methods

Construction of expression vectors for heterologous expression of the enzymes ISRed, BHAA, BHAD and AsGAT as well as the regulatory protein BHAR The gene encoding for the iminosuccinate reductase enzyme from *Paracoccus denitrificans* DSM 413 (ISRed; nucleic acid sequence shown in SEQ ID NO: 969; amino acid sequence shown in SEQ ID NO: 135) was cloned into the standard expression vector pET16b (commercially available from Merck Millipore). To this end, the ISRed gene was amplified from genomic DNA of *Paracoccus denitrificans* DSM 413 with the primers

```
                                         (SEQ ID NO: 976)
5'-GACGCCTCATATGCTCGTCGTCGCCGAAAAG-3'

(SEQ ID NO: 977)
5'-GCCACTCCTCGAGTCAGATCTCGACCTCTTG-3'
```

The resulting PCR product was digested with the endonucleases NdeI and XhoI and ligated into the expression vector pET16b to create a vector for heterologous expression of ISRed.

The gene encoding for the β-hydroxyaspartate aldolase enzyme from *Paracoccus denitrificans* DSM 413 (BHAA; nucleic acid sequence shown in SEQ ID NO: 970; amino acid sequence shown in SEQ ID NO: 971) was cloned into the standard expression vector pET16b (commercially available from Merck Millipore). To this end, the BHAA gene was amplified from genomic DNA of *Paracoccus denitrificans* DSM 413 with the primers

```
                                         (SEQ ID NO: 978)
5'-GACGCCGCATATGAACGCGAAAACGGATTTC-3'

(SEQ ID NO: 979)
5'-GACACCTGGATCCTCAGTAGCCCTTTCCG-3'
```

The resulting PCR product was digested with the endonucleases NdeI and BamHI and ligated into the expression vector pET16b to create a vector for heterologous expression of BHAA.

The gene encoding for the β-hydroxyaspartate dehydratase enzyme from *Paracoccus denitrificans* DSM 413 (BHAD; nucleic acid sequence shown in SEQ ID NO: 972; amino acid sequence shown in SEQ ID NO: 973) was cloned into the standard expression vector pET16b (commercially available from Merck Millipore).

To this end, the BHAD gene was amplified from genomic DNA of *Paracoccus denitrificans* DSM 413 with the primers

```
                                         (SEQ ID NO: 980)
5'-GACGCTGCATATGTATATCCCGACCTATGAG-3'

(SEQ ID NO: 981)
5'-GACACTCGGATCCTCAGTTCCACGGCAGCTTG-3'
```

The resulting PCR product was digested with the endonucleases NdeI and BamHI and ligated into the expression vector pET16b to create a vector for heterologous expression of BHAD.

The gene encoding for the aspartate-glyoxylate aminotransferase enzyme from *Paracoccus denitrificans* DSM 413 (AsGAT; nucleic acid sequence shown in SEQ ID NO: 433; amino acid sequence shown in SEQ ID NO: 974) was cloned into the standard expression vector pET16b (commercially available from Merck Millipore). To this end, the AsGAT gene was amplified from genomic DNA of *Paracoccus denitrificans* DSM 413 with the primers

```
                                         (SEQ ID NO: 982)
5'-GCCACTACATATGACCAGCCAGAACCC-3'

(SEQ ID NO: 983)
5'-GCCACTCGGATCCTCAGGCGGCTTTCTTCTGC-3'
```

The resulting PCR product was digested with the endonucleases NdeI and BamHI and ligated into the expression vector pET16b to create a vector for heterologous expression of AsGAT.

The gene encoding for the BHA-regulatory protein from *Paracoccus denitrificans* DSM 413 (BHAR; nucleic acid sequence shown in SEQ ID NO: 975; amino acid sequence shown in SEQ ID NO: 732) was cloned into the standard expression vector pET16b (commercially available from Merck Millipore). To this end, the BHAR gene was amplified from genomic DNA of *Paracoccus denitrificans* DSM 413 with the primers

```
                                         (SEQ ID NO: 984)
5'-GCCACATCATATGTCGGTTCAAATCC-3'

(SEQ ID NO: 985)
5'-GTCACTCGGATCCTCAGGCTCTTTCGCCGGCATC-3'
```

The resulting PCR product was digested with the endonucleases NdeI and BamHI and ligated into the expression vector pET16b to create a vector for heterologous expression of BHAR.

Heterologous Expression and Purification of Recombinant Proteins

Enzymes of the BHAP

For heterologous overexpression of the AsGAT, BHAD, BHAA and ISRed enzymes, respectively, the corresponding plasmid encoding the respective enzyme was first transformed into chemically competent *E. coli* BL21 AI cells. The cells were then grown on LB agar plates containing 100 μg mL$^{-1}$ ampicillin at 37° C. overnight. A starter culture in selective LB medium was inoculated from a single colony on the next day and left to grow overnight at 37° C. in a shaking incubator. The starter culture was used on the next day to inoculate an expression culture in selective TB medium in a 1:100 dilution. The expression culture was grown at 37° C. in a shaking incubator to an OD$_{600}$ of 0.5 to 0.7, induced with 0.5 mM IPTG and 0.2% L-arabinose and subsequently grown overnight at 18° C. in a shaking incubator.

Cells were harvested at 6,000×g for 15 min at 4° C. and cell pellets were stored at −20° C. until purification of enzymes. Cell pellets were resuspended in twice their volume of buffer A (300 mM NaCl, 25 mM Tris-HCl pH 8.0, 15 mM imidazole, 1 mM β-mercaptoethanol, 0.1 mM MgCl$_2$, 0.01 mM pyridoxalphosphate (PLP), and one tablet of SIGMAFAST™ protease inhibitor cocktail, EDTA-free per L). The cell suspension was treated with a Sonopuls GM200 sonicator (BANDELIN Electronic GmbH & Co. KG, Berlin, Germany) at an amplitude of 50% in order to lyse the cells and subsequently centrifuged at 50,000×g and 4° C. for 1 h. The filtered supernatant (0.45 µm filter, Sarstedt, Numbrecht, Germany) was loaded onto Protino® Ni-NTA Agarose (Macherey-Nagel, Düren, Germany) in a gravity column, which had previously been equilibrated with 5 column volumes of buffer A. The column was washed with 20 column volumes of buffer A and 5 column volumes of 85% buffer A and 15% buffer B and the His-tagged protein was eluted with buffer B (buffer A with 500 mM imidazole). The eluate was desalted using PD-10 desalting columns (GE Healthcare, Chicago, USA) and buffer C (100 mM NaCl, 25 mM Tris-HCl pH 8.0, 1 mM MgCl$_2$, 0.01 mM PLP, 0.1 mM dithiothreitol (DTT)). This was followed by purification on a size exclusion column (Superdex™ 200 µg, HiLoad™ 16/600; GE Healthcare, Chicago, USA) connected to an ÄKTA Pure system (GE Healthcare, Chicago, USA) using buffer C. 2 mL concentrated protein solution was injected, and flow was kept constant at 1 mL min$^{-1}$. Elution fractions containing pure protein were determined via SDS-PAGE analysis (Laemmli 1970) on 12.5% gels. Purified enzymes in buffer C were used for crystallization or stored at −20° C. in buffer C containing 50% glycerol for later use in enzymatic assays. BhcR was expressed and purified in the same way, except that buffer A contained 100 mM KCl, 20 mM HEPES-KOH pH 7.5, 10 mM MgCl$_2$, 4 mM β-mercaptoethanol, 5% glycerol and one tablet of SIGMAFAST™ protease inhibitor cocktail, EDTA-free per L. Buffer C contained 100 mM KCl, 20 mM HEPES-KOH pH 7.5, 10 mM MgCl$_2$, 5% glycerol and 1 mM DTT. NADH-dependent malate dehydrogenase (Mdh) and NADPH-dependent glyoxylate reductase (GhrA) from *E. coli* were overexpressed using the respective strains from the ASKA collection (Kitagawa, Ara et al. 2005). A starter culture in selective LB medium (34 µg mL$^{-1}$ chloramphenicol) was inoculated from a single colony and left to grow overnight at 37° C. in a shaking incubator. The starter culture was used on the next day to inoculate an expression culture in selective TB medium in a 1:100 dilution. The expression culture was grown at 37° C. in a shaking incubator to an OD$_{600}$ of 0.6, induced with 0.5 mM IPTG and grown for four more hours at 37° C. in a shaking incubator. The enzymes were affinity-purified in the same way as described above, except that buffer A contained 200 mM NaCl, 50 mM potassium phosphate pH 7.0, 15 mM imidazole, 1 mM β-mercaptoethanol, and one tablet of SIGMAFAST™ protease inhibitor cocktail, EDTA-free per L. Buffer C contained 100 mM NaCl, 50 mM potassium phosphate pH 7.0, and 0.1 mM DTT. The purified enzyme was stored at −20° C. in buffer C containing 50% glycerol.

Construction of T-DNA vectors for BHAP enzyme expression and localization studies The construction of all T-DNA vectors used in this study relies on the Golden Gate cloning based MoClo kit (Weber et al., *PLoS ONE* 2011). The MoClo kit contains a set of 95 empty standardized genetic modules that can be used for hierarchical assembly based on the Golden Gate cloning technique. This kit is comprised of plasmids for cloning: promoters, 5' untranslated regions, signal peptides, coding sequences, and terminators. The MoClo kit can be used to assemble any eukaryotic multigene construct. In-vitro synthesized BHAP genes were matured for the Golden Gate system by removing internal BpiI and BsaI restriction enzyme sites. Golden Gate assembly was performed in a 15 µl reaction (10 U BpiI/BsaI, 400 U T4 DNA Ligase, 1×T4 DNA Ligase buffer) with a 50 cycles digestion-ligation cycle (37° C. for 2 minutes and 16° C. for 5 minutes) followed by 5 minutes at 37° C. and 10 minutes at 65° C.

The plant-codon optimized gene for the iminosuccinate reductase enzyme from *Paracoccus denitrificans* DSM 413 (ISRed; nucleic acid sequence shown in SEQ ID NO: 900; amino acid sequence shown in SEQ ID NO: 901) was cloned into the Level 0 vector pICH41308 by golden gate assembly. To this end, the ISRed gene was amplified with the primers

```
                                        (SEQ ID NO: 927)
5'-ttgaagacaaaATGTACCCTTACGATGTGCCTG-3'

(SEQ ID NO: 928)
5'-ttgaagacaaaagcTCAGAGCTTAGAGATCTCGACCTC-3'
```

The plant-codon optimized gene for the β-hydroxyaspartate aldolase enzyme from *Paracoccus denitrificans* DSM 413 (BHAA; nucleic acid sequence shown in SEQ ID NO: 902; amino acid sequence shown in SEQ ID NO: 903) was cloned into the Level 0 vector pICH41308 12 by golden gate assembly. To this end, the BHAA gene was amplified with the primers

```
                                        (SEQ ID NO: 929)
5'-ttgaagacaaaATGCATCACCATCACCACCACCGATTAGCTGTTCTCT

CAGGTCATTTAAACGCTAAGACCGACTTTTC-3'

(SEQ ID NO: 930)
5'-ttgaagacaacgaaccGATCTCGACCTCTTGTGCAACAC-3'
```

In addition, BHAA was cloned in the Level 0 vector pAGM1299 without stop codon for C-terminal fluorescent protein fusion. To this end, the BHAA gene was amplified with the primers

```
                                        (SEQ ID NO: 931)
5'-ttgaagacaaaATGCATCACCATCACCACCACCGATTAGCTGTTCTCT

CAGGTCATTTAAACGCTAAGACCGACTTTTC-3'

(SEQ ID NO: 932)
5'-ttgaagacaacgaaccCTCGACGCAGCCAAGGAAG-3'
```

The plant-codon optimized gene for the β-hydroxyaspartate dehydratase enzyme from *Paracoccus denitrificans* DSM 413 (BHAD; nucleic acid sequence shown in SEQ ID NO: 904; amino acid sequence shown in SEQ ID NO: 905) was cloned into the Level 0 vector pICH41308 by golden gate assembly. To this end, the BHAD gene was amplified with the primers

```
                                        (SEQ ID NO: 933)
5'-ttgaagacaaaATGCATCACCATCACCAC-3'

(SEQ ID NO: 934)
5'-ttgaagacaaaagcTCAAAGCTTGCTGTTCCAC-3'
```

The plant-codon optimized gene for the aspartate:glyoxylate aminotransferase enzyme from *Paracoccus denitrificans* DSM 413 (AsGAT; nucleic acid sequence shown in SEQ ID NO: 906; amino acid sequence shown in SEQ ID NO: 907) was cloned into the Level 0 vector pICH41308 by golden gate assembly. To this end, the AsGAT gene was amplified with the primers

```
                                        (SEQ ID NO: 935)
5'-ttgaagacaaaATGTACCCTTACGATGTGC-3'

(SEQ ID NO: 936)
5'-ttgaagacaaaagcTCAAAGCTTAGAAGCAGCC-3'
```

Construction of higher-level T-DNA constructs (Level 1 & 2, Level P & M) followed the MoClo kit-based guidelines (Weber et al., 2011). The generated constructs are described in Tables 2, 3 and 4. Used promoter (p), fluorescent proteins and terminators (t) are all part of the MoClo Plant Parts kit. Used vector backbones and linker are also part of the MoClo toolkit. In addition, Arabidopsis UBIQUITIN10 promoter (UBQ10p) was added as part.

For targeting BHAP enzymes to the chloroplast and mitochondria a similar cloning strategy will be used to generate the corresponding construct for verification of the localization and implementing the pathway in plants. Regarding the localization only C-terminal fluorescent fusions can be generated due to the N-terminal localization of the target peptide for mitochondrial or chloroplastic localization.

TABLE 2

Constructs used for localization studies

| Name | Insert 1 | Vector/ backbone | Plant Resistance | Bacterial Resistance |
|---|---|---|---|---|
| pMR211 | AtUBQ10p::mCherry-ASGAT::S/RbcS3Ct | pICH86966 | Kanamycin | Kanamycin |
| pMR213 | AtUBQ10p::mCherry-BHAD::S/RbcS3Ct | pICH86966 | Kanamycin | Kanamycin |
| pMR214G | AtUBQ10p::eGFP-ISR::S/RbcS3Ct | pICH86966 | Kanamycin | Kanamycin |
| pMR261 | AtUBQ10p::BHAA-mCherry::S/RbcS3Ct | pICH86966 | Kanamycin | Kanamycin |

TABLE 3

Constructs for in vitro enzyme assays

| Name | Transcriptional unit 1 | Transcriptional unit 2 | Linker | Vector/ backbone | Bacterial Resistance |
|---|---|---|---|---|---|
| pMR225N | AtRbcS2Bp::BHAA::AtuOCSt | AtRbcS1Bp::BHAD::AtuNOSt | pICH50881 | pAGM8031 | Spectinomycin |
| pMR226 | AtRbcS3Bp::ISR::35St | AtCaBp::ASGAT::S/RbcS3Ct | pICH50900 | pAGM8055 | Spectinomycin |
| pMR268 | AtRbcS1Bp::BHAD::AtuNosT | AtRbcS3Bp::ISR::35St | pICH50892 | pAGM8043 | Spectinomycin |

TABLE 4

Construct for stable P-hydroxyaspartate pathway implementation

| Name | pMR228N |
|---|---|
| Transcriptional unit 1 | AtRbcS2Bp::BHAA::AtuOCSt |
| Transcriptional unit 2 | AtRbcS1Bp::BHAD::AtuNOSt |
| Transcriptional unit 3 | AtRbcS3Bp::ISR::35St |
| Transcriptional unit 4 | AtCaBp::ASGAT::S/RbcS3Ct |
| Linker | pICH79290 |
| Vector/backbone | pICH75322 |
| Plant Resistance | Kanamycin |
| Bacterial Resistance | Kanamycin |

Transformation of *Agrobacterium tumefaciens*

*Agrobacterium tumefaciens* GV3103::pMP90 (*A. tumefaciens*) was transformed with corresponding T-DNA constructs by electroporation. Electrocompetent *A. tumefaciens* cells were thawed on ice and 1 μg plasmid DNA was added and afterwards cells were transferred into a 2 mm electroporation cuvette (Eppendorf, Germany) and electroporated using an Eppendorf electroporator 2510 (Eppendorf, Germany) set to 25 μF, 2.4 kV, 200 Ohm, and 5 msec pulse length. After electroporation cells were resuspended in 1 ml YEP medium and incubated at 28° C. with shaking at 200 ppm before plating on YEP plates containing the appropriate antibiotics.

Transformation of *Arabidopsis thaliana*

*Arabidopsis* was transformed by floral dipping, which is a simplified method for *Agrobacterium*-mediated transformation of *Arabidopsis thaliana*. 300 ml *A. tumefaciens* overnight culture was pelleted at 1,600×g for 10 min at RT. The bacterial pellet was resuspended in 400 ml 5% (w/v) sucrose and supplemented with 0.02% (v/v) Silwet L-77. *Arabidopsis* were dipped into the *A. tumefaciens* suspension for 1 min and kept in the dark for 1 day before being transferred back to the growth chamber until seed harvesting.

Transient Expression of BHAP Enzymes in *Nicotiana benthamiana*, Protoplast Isolation and Confocal Microscopy

*A. tumefaciens* cultures were diluted to an OD600 of 0.4 in infiltration medium (10 mM MgCl2, 10 mM MES pH 5.7, 100 μM acetosyringon) and diluted equally for coexpression of two T-DNAs. Leaves of four-week-old greenhouse grown *N. benthamiana* plants were infiltrated using a syringe without a needle for transient expression. For leaf disc assays two leaf discs (1 cm diameter each) per leaf, were infiltrated similarly and harvested 5 days post infection (5 dpi).

Leaf discs were grinded, using glassbeads and windmill, and resuspended in 400 μl extraction buffer (50 mM potassium phosphate pH 7.5, 5 mM MgCl2, 1 mM EDTA, 0.1% (v/v) Triton-X 100). After centrifugation for 10 minutes at 12,000 rpm at 4° C. the supernatant was used for SDS-PAGE analysis following immunoblot analysis. For localization studies leaves were harvested two days post infection and protoplasts were isolated for confocal microscopy. Dissected leaf material was vacuum infiltrated with protoplast digestion solution (1.5% Cellulase R-10, 0.4% Macerozyme R-10, 0.4 M Mannitol, 20 mM KCl, 20 mM MES pH 5.6, 10 mM CaCl2, 0.1% BSA) and incubated at 30° C. for two hours. Protoplasts were transferred to a new tube and allowed to sediment and afterwards resuspended in W5 solution (154 mM NaCl, 25 mM $CaCl_2$, 5 mM KCl, 2 mM MES pH 5.6). Protoplasts were analysed using a Zeiss LSM 780 confocal microscope and Zeiss ZEN software. Excitation/emission wavelength settings were used as follows: CFP (458 nm/458-514 nm), GFP (488 nm/490-550 nm), mCherry (561 nm/580-625 nm), and chlorophyll A (488 nm/640-710 nm). Fiji software was used for image processing.

BHAP Enzyme Activity Assays

Each BHAP enzyme was assayed individually after 5 days transient expression in *N. benthamiana*. Leaf discs were grinded, using glass beads and windmill, and resuspended in 700 µl extraction buffer (50 mM potassium phosphate pH 7.5, 5 mM MgCl$_2$, 1 mM EDTA, 0.1% (v/v) Triton-X 100). After centrifugation for 10 minutes at 12,000 rpm at 4° C. and 25 µl of the supernatant was used per enzyme assay. All assays were carried out at 30° C. in a total volume of 300 µl. The oxidation of NADH was followed at 340 nm on a Cary 60 UV-Vis photospectometer (Agilent) in quartz cuvettes with a path length of 10 mm (Hellma Analytics).

The reaction mixture to assay AsGAT activity contained 100 mM potassium phosphate buffer pH 7.5, 0.1 mM PLP, 0.2 mM NADH, 5 mM glyoxylate, 20 mM aspartate, 25 µl of N. benthamiana leaf disc extract and 8.75 µg MDH enzyme.

The reaction mixture to assay BHAA activity contained 100 mM potassium phosphate buffer pH 7.5, 0.1 mM PLP, 0.2 mM NADH, 0.5 mM MgCl$_2$, 5 mM glyoxylate, 10 mM glycine, 25 µl of N. benthamiana leaf disc extract and 7 µg purified BHAD and 7 µg purified ISRed enzyme.

The reaction mixture to assay BHAD activity contained 100 mM potassium phosphate buffer pH 7.5, 0.1 mM PLP, 0.2 mM NADH, 2 mM β-hydroxyaspartate (BHA), 25 µl of N. benthamiana leaf disc extract and 7 µg purified ISRed enzyme. BHA (=(2R,3S)-β-hydroxyaspartate) was custom-synthesized for the inventors by the company NewChem (Newcastle upon Tyne, United Kingdom), and was determined to be >95% pure by NMR analysis.

The reaction mixture to assay ISRed activity contained 100 mM potassium phosphate buffer pH 7.5, 0.1 mM PLP, 0.2 mM NADH, 2 mM BHA, 25 µl of N. benthamiana leaf disc extract and 7 µg purified BHAD enzyme. The formation of aspartate by ISRed activity was confirmed by LC-MS/MS. To take samples for LC-MS/MS analysis, the reaction volume of the assay was increased to 600 µl and contained 100 mM potassium phosphate buffer pH 7.5, 0.1 mM PLP, 0.2 mM NADH, 2 mM BHA, 25 µl of N. benthamiana leaf disc extract and 7 µg purified BHAD enzyme. 90 µL aliquots were taken after 0, 1, 2 and 3 minutes and the reaction was immediately stopped by addition of formic acid (4% final concentration). The samples were centrifuged at 17,000×g and 4° C. for 15 min and the supernatant was subsequently used for LC-MS analysis.

The LC-MS measurements were done using an Agilent 6550 Funnel Q-TOF LC-MS system equipped with an electrospray ionization source set to negative ionization mode. Liquid chromatography (LC) was carried out as follows: The analytes were separated on an aminopropyl column (30 mm×2 mm, particle size 3 µm, 100 Å, Luna NH$_2$, Phenomenex inc.) using a mobile phase system comprised of 95:5 20 mM ammonium acetate pH 9.3 (adjusted with ammonium hydroxide to a final concentration of approximately 10 mM)/acetonitrile (A) and acetonitrile (B). Chromatographic separation was carried out using the following gradient condition at a flow rate of 250 µl min-1: 0 min 85% B; 3.5 min 0% B, 7 min, 0% B, 7.5 min 85% B, 8 min 85% B. Column oven and autosampler temperature were maintained at 15° C. The ESI source was set to the following parameters: Capillary voltage was set at 3.5 kV and nitrogen gas was used as nebulizing (20 psig), drying (13 l/min, 225 C) and sheath gas (12 l/min, 400° C.). The QTOF mass detector was calibrated prior to measurement using an ESI-L Low Concentration Tuning Mix (Agilent) with residuals and corrected residuals less than 2 ppm and 1 ppm respectively. MS data were acquired with a scan range of 50-600 m/z. Autorecalibration was carried out using 113 m/z as reference mass. Subsequent peak integration of all analytes was performed using the eMZed software, which is specific for the development of LCMS data analysis.

The same procedure was used to assay the activity of the enzymes purified from E. Coli BL21 implemented with the BHAP:

The above described assay conditions are used to measure individually BHAP enzyme activity in the generated Arabidopsis thaliana BHAP plants. Therefore, leaves of four-week old transgenic lines expressing the BHAP are harvested and total leaf protein is extracted as stated above. The optimal volume of crude leaf extract in the enzymatic assays needs to be optimized. In order to distinguish between aspartate formation by ISRed activity and leaf extract aspartate aminotransferase activity, $^{15}$N-glycine will be used in BHAA assays as substrate to measure $^{15}$N-aspartate enrichment over time by LC/MS.

Verification of BHAP Implementation in Arabidopsis thaliana.

Seeds of primary transformants with the nucleic acid construct were harvested four weeks after transformation and plated on 0.5× Murashige & Skoog (MS) medium containing kanamycin as selection marker (50 µg/ml). After stratification at 4° C. for 2 days in the dark, seeds were grown in a growth chamber (100 µmol photons m$^{-2}$s$^{-1}$) at high CO$_2$ concentrations (3000 ppm) under normal day conditions (12 h day/12 h night, 22° C.). Seedlings were grown on plates for 12 days and transferred to soil and grown under the same conditions as described.

Leaves of four-week-old plants were harvested in liquid nitrogen for genomic DNA isolation. Leaf material was grinded using glass beads and windmill and resuspended in 400 µl extraction buffer (250 mM Tris-HCl pH 7.5, 250 mM NaCl, 25 mM EDTA, 0.5% (w/v) SDS) and 150 µl 3 M potassium acetate. After vortexing samples were centrifuged at 12,000 rpm for 5 minutes. Supernatant was transferred to a new tube containing 550 µl 100% isopropanol and inverted several times. Samples were again centrifuges for 5 minutes at 12,000 rpm and the supernatant was discarded. DNA pellet was washed with 300 µl 70% (v/v) ethanol and centrifuged for 5 minutes at 12,000 rpm. The supernatant was discarded and the pellet after 10 minutes ethanol evaporation resuspended in 50 µl TE-Buffer (10 mM Tris-HCl pH 7.5, 0.1 mM EDTA). 2 µl of resuspended DNA was used for PCR. The complete integration of all four BHAP enzymes was verified using a combination of forward and reverse primers specific for the promoter and the coding sequence.

Integration of AsGAT under control of the chlorophyll A binding protein promoter was verified with the primers

```
                                    (SEQ ID NO: 937)
        5'-GACTAGCCAATAGCAACCTC-3'

(SEQ ID NO: 938)
        5'-CTCTGATAGCAGACACGGAAT-3'
```

Integration of BHAA under control of the RubisCO small subunit 2B promoter was verified with the primers

```
                                    (SEQ ID NO: 939)
        5'-CCAGTAGCCATACACATTCAC-3'

(SEQ ID NO: 940)
        5'-GCTTGTCGTTCACCTTGAG-3'
```

Integration of BHAD under control of the RubisCO small subunit 1B promoter was verified with the primers (SEQ ID NO: 941)
5'-GAGCCAAAGCAACCGATC-3'

(SEQ ID NO: 942)
5'-GATCTGTAAGCGTCATCAGC-3'

Integration of ISRed under control of RubisCO small subunit 3B promoter was verified with the primers (SEQ ID NO: 943)
5'-GAAAGGAGCCAAAAGCAAC-3'

(SEQ ID NO: 944)
5'-GTCCAACACCAGTTCCATC-3'

Successful gDNA isolation was confirmed by amplification of the *Arabidopsis* housekeeping gene ACTIN 2 (AT3G18780) using primers (SEQ ID NO: 945)
5'-GTTGGGATGAACCAGAAGGA-3'

(SEQ ID NO: 946)
5'-GAACCACCGATCCAGACACT-3'

To verify homozygosity of the ggt1 mutant a gene-specific/T-DNA specific primer pair was used. Wildtype GGT1 was amplified using primers (SEQ ID NO: 947)
5'-CCTTGCCCTTGGCTCTAGAACC-3'

(SEQ ID NO: 948)
5'-GTCATACCTAAACCGCCTGAAGTC-3'

The T-DNA integration in the GGT1 locus in the ggt1 mutant was verified using primers (SEQ ID NO: 949)
5'-TAACTCTCCCCACTCTTTGCC-3'

(SEQ ID NO: 950)
5'-ATATTGACCATCATACTCATTGC-3'

TABLE 5

Description of the Sequence List

| SEQ ID No | Description | Type |
|---|---|---|
| 1-299 | IsRed enzyme | Amino Acid |
| 300-599 | AsGAT enzyme | Amino Acid |
| 600-899 | β-hydroxyaspartate regulatory protein | Amino Acid |
| 900 | *Arabidopsis* codon-optimized sequence of IsRed enzyme from *Paracoccus denitrificans* DSM 413 targeted to plant peroxisomes | Nucleic acid |
| 901 | IsRed enzyme from *Paracoccus denitrificans* DSM 413 containing a plant peroxisome targeting sequence | Amino acid |
| 902 | *Arabidopsis* codon-optimized sequence of BHAA enzyme from *Paracoccus denitrificans* DSM 413 containing a plant peroxisome targeting sequence | Nucleic acid |
| 903 | BHAA enzyme from *Paracoccus denitrificans* DSM 413 containing a plant peroxisome targeting sequence | Amino acid |
| 904 | *Arabidopsis* codon-optimized sequence of BHAD enzyme from *Paracoccus denitrificans* DSM 413 targeted to plant peroxisomes | Nucleic acid |
| 905 | BHAD enzyme from *Paracoccus denitrificans* DSM 413 containing a plant peroxisome targeting sequence | Amino acid |
| 906 | *Arabidopsis* codon-optimized sequence of AsGAT enzyme from *Paracoccus denitrificans* DSM 413 targeted to plant peroxisomes | Nucleic acid |
| 907 | AsGAT enzyme from *Paracoccus denitrificans* DSM containing a plant peroxisome targeting sequence | Amino acid |
| 908 | *Arabidopsis* codon-optimized sequence of IsRed enzyme from *Paracoccus denitrificans* DSM 413 and for cytosolic expression | Nucleic acid |
| 909 | IsRed enzyme from *Paracoccus denitrificans* DSM 413 for expression in plant cytosolic expression | Amino acid |
| 910 | *Arabidopsis* codon-optimized sequence of BHAA enzyme from *Paracoccus denitrificans* DSM 413 for expression in plant cytosol | Nucleic acid |
| 911 | BHAA enzyme from *Paracoccus denitrificans* DSM 413 for expression in plant cytosol | Amino acid |
| 912 | *Arabidopsis* codon-optimized sequence of BHAD enzyme from *Paracoccus denitrificans* DSM 413 for expression in plant cytosol | Nucleic acid |
| 913 | BHAD enzyme from *Paracoccus denitrificans* DSM 413 for expression in plant cytosol | Amino acid |
| 914 | *Arabidopsis* codon-optimized sequence of AsGAT enzyme from *Paracoccus denitrificans* DSM 413 for expression in plant cytosol | Nucleic acid |
| 915 | AsGAT enzyme from *Paracoccus denitrificans* DSM 413 for expression in plant cytosol | Amino acid |
| 916 | *Arabidopsis* Ferredoxin-2 chloroplastic target peptide for N-terminal fusion to target BHAP proteins to plant chloroplasts. | Nucleic acid |
| 917 | *Arabidopsis* Ferredoxin-2 chloroplastic target peptide for N-terminal fusion to target BHAP proteins to plant chloroplasts. | Amino acid |
| 918 | *Arabidopsis* serine hydroxymethyl transferase target peptide for N-terminal fusion to target BHAP proteins to plant mitochondria. | Nucleic acid |
| 919 | *Arabidopsis* serine hydroxymethyl transferase target peptide for N-terminal fusion to target BHAP proteins to plant mitochondria | Amino acid |

TABLE 5-continued

Description of the Sequence List

| SEQ ID No | Description | Type |
|---|---|---|
| 920 | Nucleic acid sequence coding *Dicosoma* sp. red fluorescent protein (m Cherry) | Nucleic acid |
| 921 | *Dicosoma* sp. red fluorescent protein (mCherry) | Amino acid |
| 922 | Nucleic acid sequence coding enhanced green fluorescent protein | Nucleic acid |
| 923 | enhanced green fluorescent protein | Amino acid |
| 924 | *Agrobacterium tumefaciens* NOS promoter | Nucleic acid |
| 925 | *Agrobacterium tumefaciens* MAS promoter | Nucleic acid |
| 926 | cauliflower mosaic virus 35S promoter | Nucleic acid |
| 927 | primer for cloning of IsRed in pICH41308, fwd | Nucleic Acid |
| 928 | primer for cloning of IsRed in pICH41308, rev | Nucleic Acid |
| 929 | primer for cloning of BHAA in pICH41308, fwd | Nucleic Acid |
| 930 | primer for cloning of BHAA in pICH41308, rev | Nucleic Acid |
| 931 | primer for cloning of BHAA in pAGM1299 without stop codon, fwd | Nucleic Acid |
| 932 | primer for cloning of BHAA in pAGM1299 without stop codon, rev | Nucleic Acid |
| 933 | primer for cloning of BHAD in pICH41308, fwd | Nucleic Acid |
| 934 | primer for cloning of BHAD in pICH41308, rev | Nucleic Acid |
| 935 | primer for cloning of AsGAT in pICH41308, fwd | Nucleic Acid |
| 936 | primer for cloning of AsGAT in pICH41308, rev | Nucleic Acid |
| 937 | Primer used to assess the integration of AsGAT under control of chlorophyll A binding protein promoter, fwd | Nucleic Acid |
| 938 | Primer used to assess the integration of AsGAT under control of chlorophyll A binding protein promoter, rev | Nucleic Acid |
| 939 | Primer used to assess the integration of BHAA under control of RubisCO small subunit 2B promoter, fwd | Nucleic Acid |
| 940 | Primer used to assess the integration of BHAA under control of RubisCO small subunit 2B promoter, rev | Nucleic Acid |
| 941 | Primer used to assess the integration of BHAD under control of RubisCO small subunit 1B promoter, fwd | Nucleic Acid |
| 942 | Primer used to assess the integration of BHAD under control of RubisCO small subunit 1B promoter, rev | Nucleic Acid |
| 943 | Primer used to assess the integration of ISRed under control of RubisCO small subunit 3B promoter, fwd | Nucleic Acid |
| 944 | Primer used to assess the integration of ISRed under control of RubisCO small subunit 3B promoter, rev | Nucleic Acid |
| 945 | Primer for Actin 2 amplification, fwd | Nucleic Acid |
| 946 | Primer for Actin 2 amplification, rev | Nucleic Acid |
| 947 | Primer for wildtype GGT1 amplification, fwd | Nucleic Acid |
| 948 | Primer for wildtype GGT1 amplification, rev | Nucleic Acid |
| 949 | primer for verification of T-DNA integration in the GGT1 locus, fwd | Nucleic Acid |
| 950 | primer for verification of T-DNA integration in the GGT1 locus, rev | Nucleic Acid |
| 951 | nucleic acid sequence coding the peroxisomal targeting signal 2 (PTS2) from *Arabidopsis* peroxisomal citrate synthase 3 (At2g42790) | Nucleic acid |
| 952 | peroxisomal targeting signal 2 (PTS2) from *Arabidopsis* peroxisomal citrate synthase 3 (At2g42790) | Amino acid |
| 953 | Pden_3919 BHAA | Amino acid |
| 954 | Pden_3920 BHAD | Amino acid |
| 955 | BHAA enzyme derived from *Paracoccus denitrificans* DSM 413 containing a plant peroxisome targeting sequence and without tag for immunoblot analysis | Amino acid |
| 956 | BHAD enzyme from *Paracoccus denitrificans* DSM 413 containing a plant peroxisome targeting sequence and without tags for immunoblot | Amino acid |
| 957 | ISRed enzyme derived from *Paracoccus denitrificans* DSM 413 containing a plant peroxisome targeting sequence and without tags for immunoblot | Amino acid |
| 958 | AsGAT enzyme derived from *Paracoccus denitrificans* DSM 413 containing a plant peroxisome targeting sequence and without tags for immunoblot analysis | Amino acid |
| 959 | Arabidopsis codon-optimized sequence of BHAA enzyme from *Paracoccus denitrificans* DSM 413 containing a plant peroxisome targeting sequence, and without tags for immunoblot analysis | Nucleic acid |
| 960 | Arabidopsis codon-optimized sequence of BHAD enzyme from *Paracoccus denitrificans* DSM 413 containing a plant peroxisome targeting sequence and without tags for imunoblot analysis | Nucleic acid |
| 961 | Arabidopsis codon-optimized sequence of ISRed enzyme from *Paracoccus denitrificans* DSM containing a plant peroxisome targeting sequence and without tags for immunoblot analysis | Nucleic acid |
| 962 | Arabidopsis codon-optimized sequence of AsGAT enzyme from *Paracoccus denitrificans* DSM 413 containing a plant peroxisome targeting sequence, and without tags for immunoblot analysis | Nucleic acid |
| 963 | Arabidopsis codon-optimized sequence of BHAA enzyme from *Paracoccus denitrificans* DSM 413 for expression in plant cytosol | Nucleic acid |
| 964 | Arabidopsis codon-optimized sequence of BHAD enzyme from *Paracoccus denitrificans* DSM 413 for expression in plant cytosol | Nucleic acid |

TABLE 5-continued

Description of the Sequence List

| SEQ ID No | Description | Type |
|---|---|---|
| 965 | Arabidopsis codon-optimized sequence of IsRed enzyme from *Paracoccus denitrificans* DSM 413 for expression in plant cytosol | Nucleic acid |
| 966 | Arabidopsis codon-optimized sequence of AsGAT enzyme from *Paracoccus denitrificans* DSM 413 for expression in plant cytosol | Nucleic acid |
| 967 | Conserved amino acid sequence of the IsRed enzymes | Amino acid |
| 968 | Conserved amino acid sequence of the AsGAT enzymes | Amino acid |
| 969 | IsRed enzyme from *Paracoccus denitrificans* DSM 413 | Nucleic acid |
| 970 | BHAA enzyme from *Paracoccus denitrificans* DSM 413 | Nucleic acid |
| 971 | BHAA enzyme from *Paracoccus denitrificans* DSM 413 | Amino acid |
| 972 | BHAD enzyme from *Paracoccus denitrificans* DSM 413 | Nucleic acid |
| 973 | BHAD enzyme from *Paracoccus denitrificans* DSM 413 | Amino acid |
| 974 | AsGAT enzyme from *Paracoccus denitrificans* DSM 413 | Nucleic acid |
| 975 | BHA-regulatory protein from *Paracoccus denitrificans* DSM 413 | Nucleic acid |
| 976 | Primer for cloning of ISRed from *Paracoccus denitrificans* DSM 413 into pET16b, fwd | Nucleic acid |
| 977 | Primer for cloning of ISRed from *Paracoccus denitrificans* DSM 413 into pET16b, rev | Nucleic acid |
| 978 | Primer for cloning of BHAA from *Paracoccus denitrificans* DSM 413 into pET16b, fwd | Nucleic acid |
| 979 | Primer for cloning of BHAA from *Paracoccus denitrificans* DSM 413 into pET16b, rev | Nucleic acid |
| 980 | Primer for cloning of BHAD from *Paracoccus denitrificans* DSM 413 into pET16b, fwd | Nucleic acid |
| 981 | Primer for cloning of BHAD from *Paracoccus denitrificans* DSM 413 into pET16b, rev | Nucleic acid |
| 982 | Primer for cloning of AsGAT from *Paracoccus denitrificans* DSM 413 into pET16b, fwd | Nucleic acid |
| 983 | Primer for cloning of AsGAT from *Paracoccus denitrificans* DSM 413 into pET16b, rev | Nucleic acid |
| 984 | Primer for cloning of BHAR from *Paracoccus denitrificans* DSM 413 into pET16b, fwd | Nucleic acid |
| 985 | Primer for cloning of BHAR from *Paracoccus denitrificans* DSM 413 into pET16b, rev | Nucleic acid |
| 986 | multigene T-DNA construct pMR228N for BHAP implementation in plant peroxisomes. | Nucleic acid |

Phenotypic Analysis

*Arabidopsis thaliana* seeds are plated on 0.5× Murashige & Skoog (MS) medium containing kanamycin as selection marker (50 µg/ml) for segregation analysis to confirm homozygous integration of the nucleic acid construct (T-DNA). Seeds of homozygous plants are plated on 0.5× Murashige & Skoog (MS) medium without selection marker. After stratification at 4° C. for 2 days in the dark, seeds are grown in a growth chamber (100 µmol photons $m^{-2}s^{-1}$) at ambient 002 concentrations (400 ppm) under normal day conditions (12 h day/12 h night, 22° C.). Alternatively, plants are shifted between ambient $CO_2$ concentrations (400 ppm) and high $CO_2$ concentrations (3000 ppm) under normal day conditions (12 h day/12 h night, 22° C.). In order to determine phenotypic parameters, the plants are imaged and rosette size and leaf size are analysed using Fiji software. Leaf fresh weight is measured by weighting leaves from comparable developmental stages.

As a matter of photorespiratory stress protection chlorophyll fluorescence ($F_v/F_m$) upon shift between low (100 ppm $CO_2$), ambient and high $CO_2$ concentrations are measured using an Imaging PAM (Walz, Germany). Seedlings are dark exposed for 15 minutes and exposed to saturating light pulse (10 000 µmol photons $m^{-2}$ $s^{-1}$ for 800 ms). Photosynthetic parameters are recorded with pre-illuminates plants grown at 100 µmol photons $m^{-2}$ $s^{-1}$ with stepwise increasing light intensities up to 1600 µmol photons $m^{-2}$ $s^{-1}$ using the Dual-PAM. ETR I, ETR II, NPQ, Y(NPQ), Y(NO) are calculated by the Dual-PAM 100 software.

Gas Exchange Measurements

Photosynthetic rates are measured using a LI-6400XT portable photosynthesis analyzer (LI-COR Environmental). Conditions were maintained at 1500 µmol $m^{-2}$ $s^{-1}$ photon flux and $A/C_i$ curves are determined by stepwise changes in external $CO_2$ supply ranging from 50 to 2000 ppm. Based on the initial slope of the $A/C_i$ curve the maximum rate of carboxylation ($V_{cmax}$) and maximum electron transport rate ($J_{max}$) is calculated. Inhibition of photosynthesis by oxygen is assessed by determining the $CO_2$ compensation point in the presence of different oxygen concentrations (2-40%). The $CO_2$ compensation point is less affected in the BHAP implemented lines as compared to the wild type.

Transformation of *Nicotiana tabacum*.

The implementation of the BHAP in tobacco is achieved by transforming *Nicotiana tabacum* leaf discs with pMR228N as described in Gallois et al. in Methods in Molecular Biology 1995, vol. 49, p. 39.

Free Ammonium Quantification in Plant Tissue

Free ammonium was quantified in plant tissue using a colorimetric assay as previously described. In detail, 10 mg of grinded material was resuspended in 100 µL chloroform and 200 µl 100 mM HCl. Samples were rotated for 15 minutes at 4° C. and centrifuged at 12,000×g for 10 minutes at 4° C. 150 µl of the aqueous phase was transferred to a new tube containing 10 mg washed charcoal and centrifuged for 5 minutes at 4° C. at 16,000×g. 50 µl of the supernatant was mixed with 50 µl 100 mM HCl and used for further processing. Assay conditions were as follow. 20 µl of sample were mixed with 100 µl solution A, containing 1% (w/v) phenol and 0.005% (w/v) sodium nitroprusside solution in water and 100 μl solution B, containing 1% (v/v) sodium hypochlorite and 0.5% (w/v) sodium hydroxide solution in water. The assay mixture was incubated at 37° C. for 30 minutes and absorbance was measured using a Synergy™ HTX Multi-Mode Microplate Reader (BioTek). Total ammonium quantification was calculated based on a standard curve.

Metabolite Profiling

For metabolite profiling green tissue of 14 days old seedlings was harvested by immediate quenching with liquid nitrogen at the middle of the light phase. Frozen material was grinded using a precooled mortar and pestil. Grinded material was aliquoted under continuous liquid nitrogen expose to avoid sample thawing. 50 mg of leaf material is used for metabolite extraction using a one-phase extraction protocol as previously described. In detail, 1.5 ml of extraction mix, containing water:methanol:chloroform at ratio 1:2.5:1 and 5 μM ribitol as internal standard, was added to frozen material. Samples were vortexed for 20 seconds, rotated for 6 minutes at 4° C. and centrifuged for 2 minutes at 20,000×g at room temperature. The supernatant was transferred to a new tube and stored at −80° C. before further processing. For metabolite profiling by gas chromatography-mass spectrometry (GC-MS), 50 μl of extract was dried using a speed vacuum concentrator. Dried samples were placed in the Gerstel MPS 2 XL autosampler for automatic sample derivatization using methoxyamine hydrochloride and N-Methyl-N-(trimethylsilyl) trifluoroacetamide before injection. The GC-MS device is a 7200 accurate mass Q-TOF GC/MS (Agilent). For relative quantification metabolite peak areas are normalized to the internal extraction standard and the material fresh weight.

Example 1—Kinetic Characterization of the Enzymes of the β-Hydroxyaspartate Pathway (BHAP) and Reconstruction of the BHAP In Vitro The genes encoding for the four enzymes of the BHAP in the genome of *Paracoccus denitrificans* DSM 413 were identified and these four proteins were heterologously expressed in *E. coli*. The four enzymes were purified and subjected to kinetic characterization by conducting suitable enzyme assays. Kinetic parameters of the enzymes are summarized in Table 1. The complete reaction sequence of the BHAP, catalyzed by these four enzymes, is shown in FIG. 1.

Figure 2:
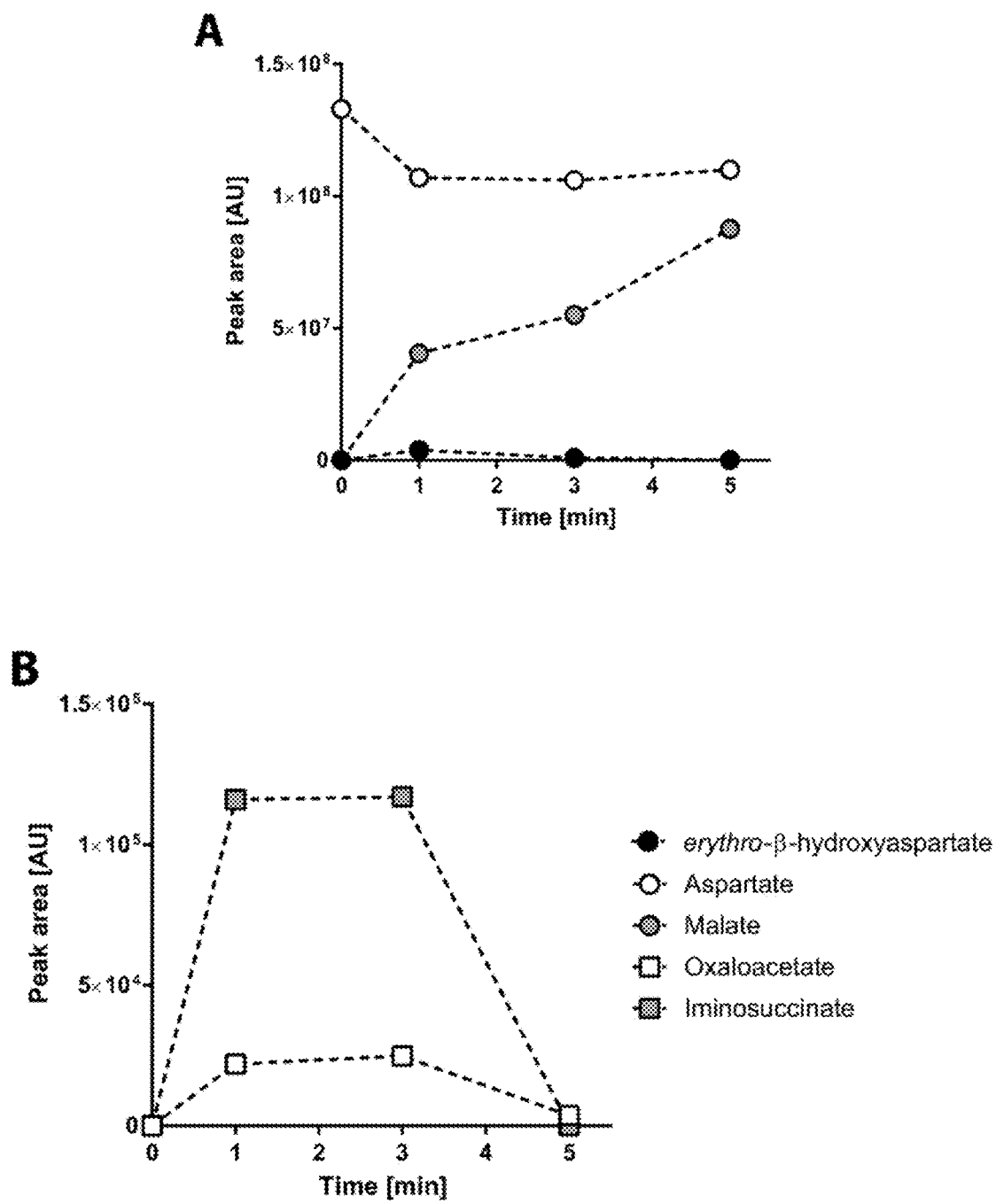
FIG. 2: In vitro assay with the four enzymes of the BHAP and malate dehydrogenase. Metabolites were quantified via LC-MS analysis. Glyoxylate (not measurable with this method) and aspartate (white circles) were added to produce malate (grey circles), as shown in panel A. The intermediate metabolites of the pathway (erythro-β-hydroxyaspartate, oxaloacetate, iminosuccinate) were also measured successfully, as shown in panel A and B.

To assess the efficiency of the BHAP in converting its input molecule (glyoxylate) into its output molecule (oxaloacetate), a combined assay of all four enzymes was conducted. Additionally, the enzymes malate dehydrogenase (MDH) and formate dehydrogenase (FDH) were added. MDH converts oxaloacetate into malate, which can be analyzed well via LC-MS, while FDH as cofactor regeneration system is required for the regeneration of the cofactor NADH by oxidation of formate to carbon dioxide. The results of this assay are shown in FIG. 2 and demonstrate that the BHAP converts glyoxylate into malate with high speed and efficiency.

Furthermore, this assay demonstrates that the concentration of the required co-substrate aspartate remains largely the same over the course of the assay. With these in vitro results the stability and effectiveness of the enzyme-catalyzed reaction network is demonstrated that is the BHAP, which suggests that the pathway can also be used with high efficiency in a host microorganism, especially since it would not deplete the intracellular aspartate pool too much.

TABLE 6

Kinetic data of the four enzymes of the β-hydroxyaspartate pathway.

| Enzyme | Substrate | app. $k_{cat}$ [s$^{-1}$] | app. $K_M$ [mM] | app. $k_{cat}/K_M$ [M$^{-1}$ s$^{-1}$] |
|---|---|---|---|---|
| ISRed | Iminosuccinate | 201.04 ± 10.20 | 0.088 ± 0.010 | 2.29 * 106 |
|  | NADH | — | 0.023 ± 0.003 | — |
|  | NADPH | — | 0.33 ± 0.05 | — |
| BHAA | Glyoxylate | 85.96 ± 3.64 | 0.23 ± 0.03 | 3.72 * 105 |
|  | Glycine | 90.98 ± 02.41 | 4.31 ± 0.34 | 2.11 * 104 |
|  | (2R, 3S)-β-hydroxy-aspartate | 33.11 ± 1.29 | 0.28 ± 0.03 | 1.18 * 105 |
|  | D-Threonine | 76.21 ± 2.49 | 9.24 ± 0.86 | 8.25 * 103 |
| BHAD | (2R, 3S)-β-hydroxy-aspartate | 35.01 ± 0.82 | 0.20 ± 0.02 | 1.75 * 105 |
| AsGAT | Glyoxylate | 58.07 ± 0.82 | 0.43 ± 0.02 | 1.34 * 105 |
|  | L-Aspartate | 56.36 ± 0.73 | 2.51 ± 0.10 | 2.25 * 104 |
|  | Glycine | 0.76 ± 0.01 | 9.52 ± 0.40 | 7.97 * 101 |
|  | Oxaloacetate | 0.76 ± 0.02 | 2.90 ± 0.27 | 2.62 * 102 |
|  | L-Serine | 8.82 ± 0.31 | 2.10 ± 0.24 | 4.20 * 103 |
|  | L-Glutamate | 5.03 ± 0.26 | 20.62 ± 2.33 | 2.44 * 102 |

Example 2—Designing the β-Hydroxyaspartate Pathway (BHAP) for Implementation in Plant Peroxisomes Initially, the β-hydroxyaspartate pathway (BHAP) from *Paracoccus denitrificans* DSM 413 has been implemented in plant peroxisomes due to high expected concentrations of photorespiration-derived glyoxylate (FIG. 1). The genes coding the four enzymes (aspartate-glyoxylate aminotransferase (AsGAT), β-hydroxyaspartate aldolase (BHAA), β-hydroxyaspartate dehydratase(BHAD) and iminosuccinate reductase (ISRed)) of the BHAP were codon-optimized for expression in *Arabidopsis thaliana* (henceforth: *Arabidopsis*) by gene synthesis (Sigma Aldrich, Germany). In order to target the BHAP enzymes to plant peroxisomes, synthetic fusions with peroxisomal targeting sequences were generated. AsGAT, BHAD and ISRed were C-terminally fused with the three amino acid peroxisomal targeting signal 1 (PTS1; serine-lysine-leucine). C-terminal fusion of BHAA with PTS1 inactivated the enzyme and therefore, BHAA was N-terminally fused with the peroxisomal targeting signal 2 (PTS2) from *Arabidopsis* peroxisomal citrate synthase 3 (At2g42790). Furthermore, all four enzymes were fused with tags for immunoblot analysis. AsGAT and ISRed were N-terminally fused with a hemagglutinin A (HA)-tag and BHAA and BHAD were N-terminally fused with a 6× histidine tag (6×His).

fied via LC-MS. As shown, both aspartate and malate were formed in the respective enzyme assay (FIG. 8), with the ratio of malate aspartate being approximately 100 towards the end of the assay (FIG. 9).

TABLE 7

Required enzymes to convert 2-phosphoglycolate into oxaloacetate in the projected photorespiratory bypass. Substrates and products of all enzymes are given, with possible cofactors indicated in brackets.

| Reaction/ Enzyme no. | EC no. of enzyme to be employed | Enzyme to be employed | Examples for organisms | Natural plant localization | Substrate(s) | Product(s) | Reference |
|---|---|---|---|---|---|---|---|
| a | 2.6.1.X (not yet given) | aspartate-glyoxylate transaminase | *Paracoccus denitrificans* | — | aspartate, glyoxylate | oxaloacetate, glycine | |
| b | 4.1.3.14 | erythro-β-hydroxyaspartate aldolase | *Paracoccus denitrificans* | — | glyoxylate, glycine | erythro-β-hydroxyaspartate | |
| c | 4.3.1.20 (former 4.2.1.38) | erythro-β-hydroxyaspartate dehydratase | *Paracoccus denitrificans* | — | erythro-β-hydroxyaspartate | iminosuccinate, $H_2O$ | Biochem. J. 1965, 97(2), 547 |
| d | 1.5.1.X (not yet given) | iminosuccinate reductase | *Paracoccus denitrificans* | — | iminosuccinate (NADH) | aspartate (NAD) | |

Example 3—Demonstrating BHAP Enzyme Targeting to Plant Peroxisomes

Figure 3:
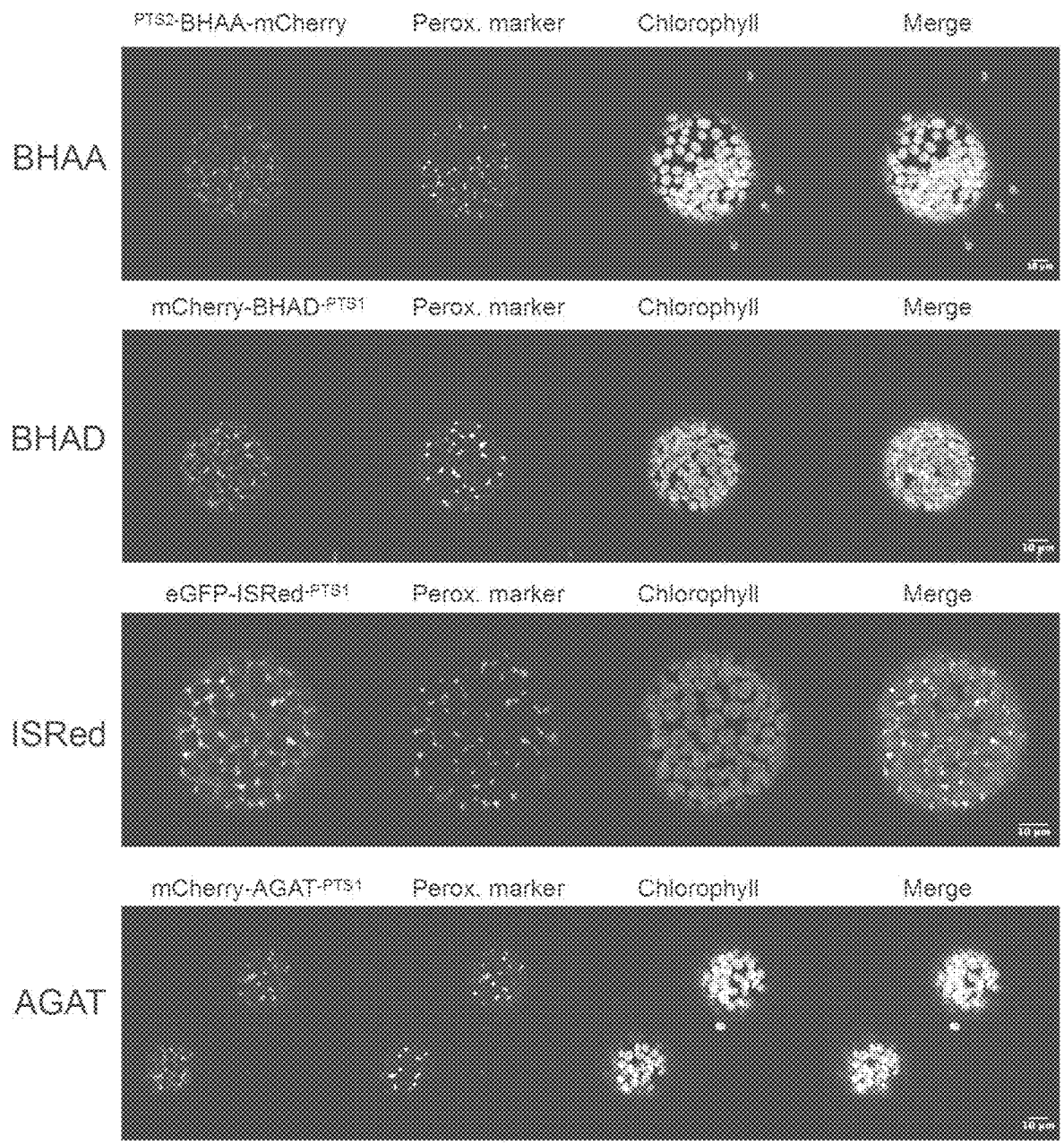
FIG. 3: shows the localization of BHAP enzymes to plant peroxisomes. Peroxisomal localization of four BHAP enzymes by co-localization studies in N. benthamiana protoplasts. Fluorescent fusion constructs were transiently expressed in N. benthamiana and protoplasts were isolated 2 days post infection. Overlap of BHAP fluorescent with peroxisomal marker (perox. marker) verify the successfully targeting of BHAP enzymes to peroxisomes.
Figure 4:
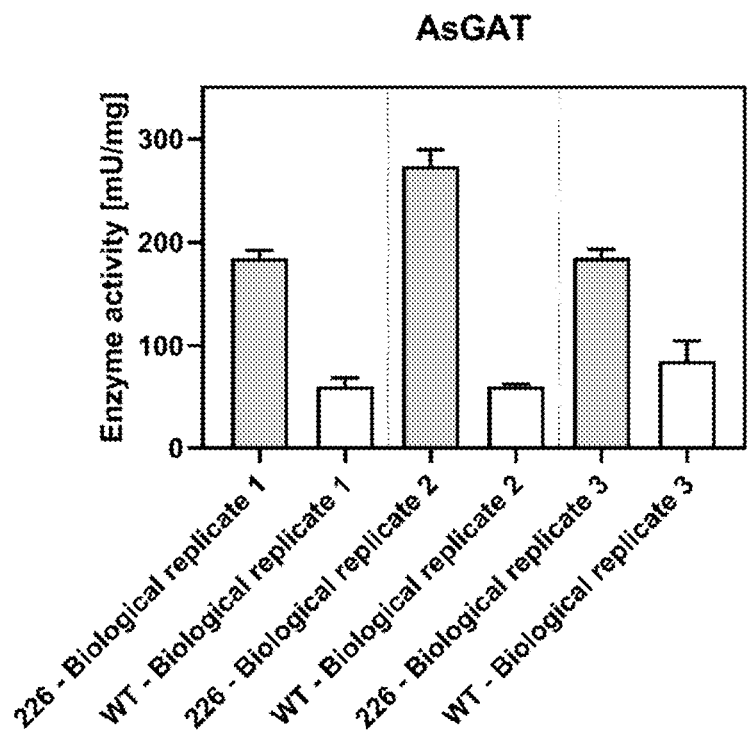
FIG. 4: shows the activity of the AsGAT enzyme in N. benthamiana plants. Enzyme activity was measured in plant cell extracts of plant lines with transient expression of the enzyme (226) and compared to WT plant cell extracts. As shown, the enzyme activity is clearly present in the transiently expressing plants and considerably higher than the background activity in WT plants. Experiments were performed in 3 biological replicates.
Figure 5:
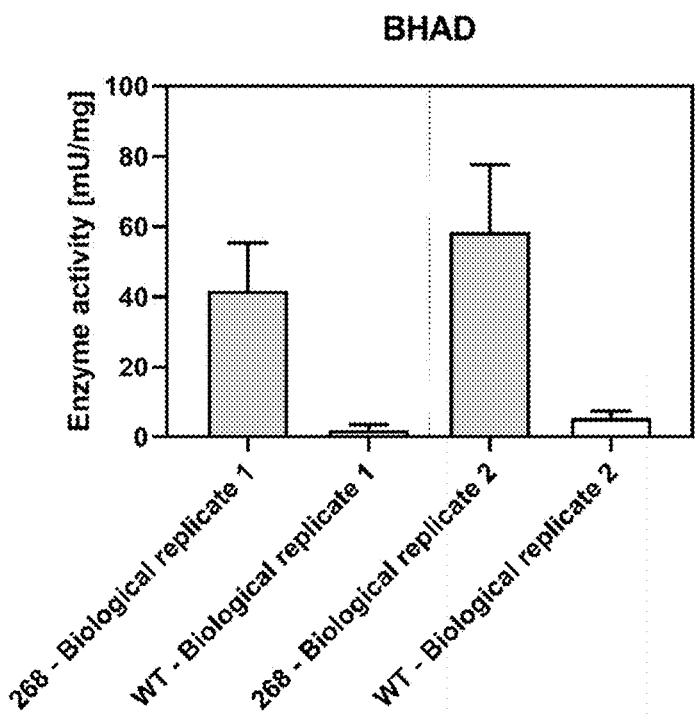
FIG. 5: shows the activity of the BHAD enzyme in N. benthamiana plants. Enzyme activity was measured in plant cell extracts of plant lines with transient expression of the enzyme (268) and compared to WT plant cell extracts. As shown, the enzyme activity is clearly present in the transiently expressing plants and considerably higher than the background activity in WT plants. Experiments were performed in two biological replicates.
Figure 6:
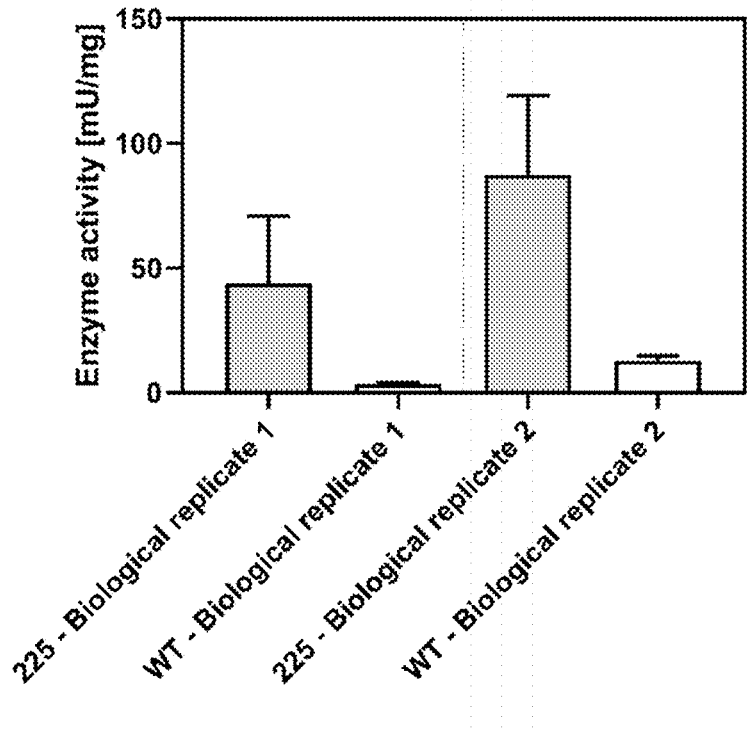
FIG. 6: shows the activity of the BHAA enzyme in N. benthamiana plants. Enzyme activity was measured in plant cell extracts of plant lines with transient expression of the enzyme (225) and compared to WT plant cell extracts. As shown, the enzyme activity is clearly present in the transiently expressing plants and considerably higher than the background activity in WT plants. Experiments were performed in two biological replicates.
Figure 7:
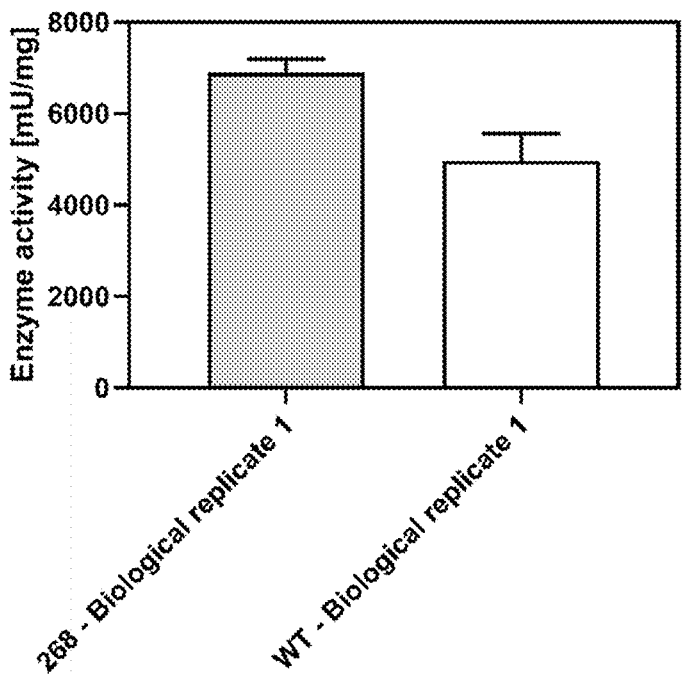
FIG. 7: shows the activity of the IsRed enzyme in N. benthamiana plants. Enzyme activity was measured in plant cell extracts of plant lines with transient expression of the enzyme (225) and compared to WT plant cell extracts. As shown, the enzyme activity is clearly present in the transiently expressing plants and considerably higher than the background activity in WT plants. Experiments were performed in one biological replicate.

The inventors were able to demonstrate the correct localization of BHAP enzymes in plant peroxisomes (FIG. 3). Peroxisomal targeting of BHAP enzymes was confirmed via co-localization studies in *Nicotiana benthamiana* (*N. benthamiana*). Fluorescent fusion constructs of BHAP enzymes were co-infiltrated with a peroxisomal organellar marker for transient expression in *N. benthamiana* and co-localization was confirmed by confocal microscopy with isolated *N. benthamiana* protoplasts (FIG. 3). AsGAT and BHAD were N-terminally fused with *Dicosoma* sp. red fluorescent protein (mCherry) (nucleic acid sequence and amino acid sequence: SEQ ID NOs 920 and 921, respectively). ISRED was N-terminally fused with an enhanced green fluorescent protein (eGFP) (nucleic acid sequence and amino acid sequence: SEQ ID NO 922 and 923, respectively) and BHAA was C-terminally fused with *Dicosoma* sp. red fluorescent mCherry. Used peroxisomal markers are either mCherry or cyan fluorescent protein (CFP) with a C-terminal PTS1 fusion. The *Arabidopsis* UBIQUITIN10 promoter was used as promoter for all constructs including organellar markers.

Example 4—BHAP Enzymatic Activity in Plants

Figure 8:
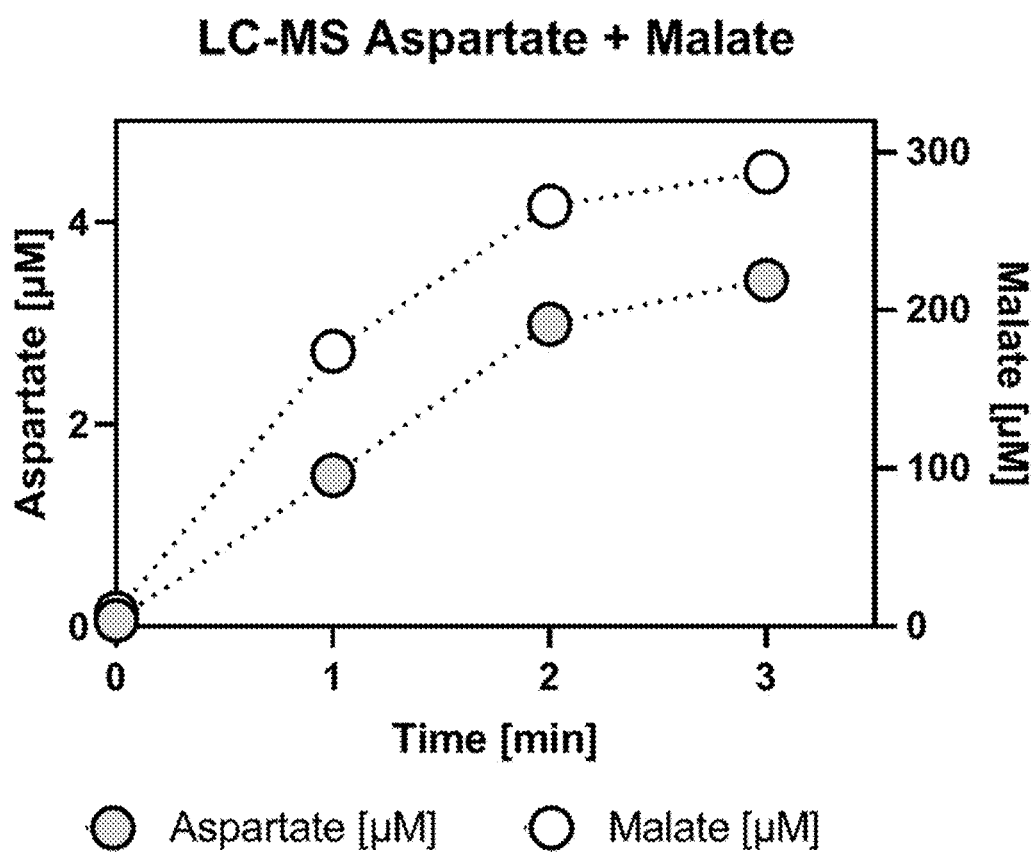
FIG. 8: shows the formation of aspartate (via IsRed) and malate (via malate dehydrogenase) as quantified via LC-MS in N. benthamiana plant cell extracts of plant lines with transient expression of IsRed. This experiment was performed in order to differentiate the activity of IsRed from malate dehydrogenase activity. As shown, both aspartate and malate were formed in the respective enzyme assay.
Figure 9:
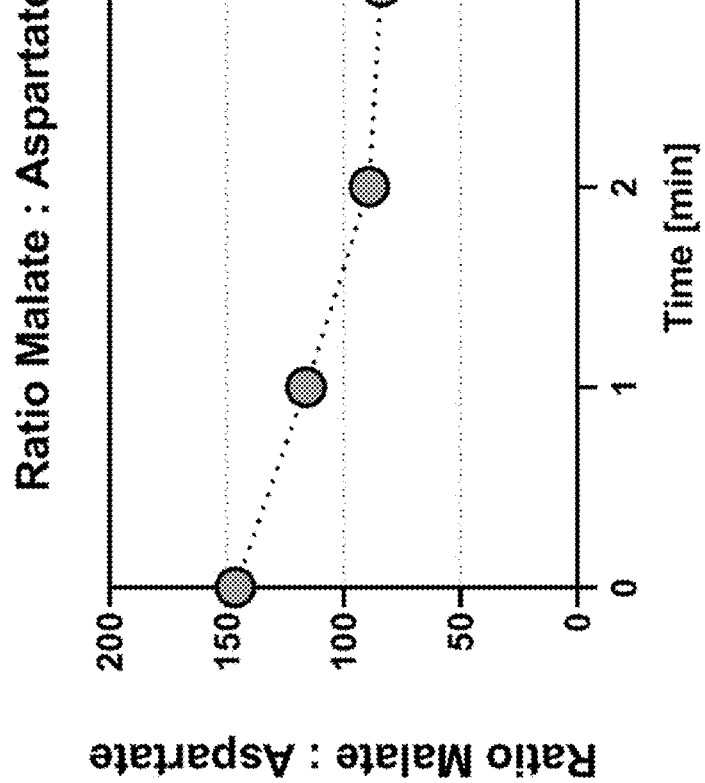
FIG. 9: shows the ratio malate:aspartate formed in the experiment described in FIG. 7. As shown, both aspartate and malate were formed in the respective enzyme assay, with the ratio of malate:aspartate being approximately 100 towards the end of the assay.

The inventors were able to demonstrate activity of each of the BHAP enzymes in *N. benthamiana* leaf extracts (FIG. 4-9). Aspartate formation by ISRed activity was validated by time-dependent increase of aspartate concentration via LC-MS (FIG. 8 and FIG. 9).

Figure 10:
FIG. 10: A schematic representation of the generated T-DNA nucleic acid construct (pMR228N, BHAP, SEQ ID NO: 986) is shown. Abbreviations: *Arabidopsis thaliana* (At), *Agrobacterium tumefaciens* (Atu), *Solanum lycopersicum* (Sl), Arabidopsis RubisCO small subunit 2B promoter (AtRbcS2Bp), beta-hydroxyaspartate aldolase (BHAA), *Agrobacterium tumefaciens* octopine synthase terminator (AtuOCSt), Arabidopsis RubisCO small subunit 1B promoter (AtRbcS1 Bp), beta-hydroxyaspartate dehydratase (BHAD), *Agrobacterium tumefaciens* nopaline synthase terminator (AtuNOSt), Arabidopsis RubisCO small subunit 3B promoter (AtRbS3Bp), iminosuccinate reductase (ISRed), 35S terminator derived from the Cauliflower Mosaic Virus (35St), Arabidopsis chlorophyll A binding protein promoter (AtCaBp), aspartate-glyoxylate aminotransferase (AsGAT), *Solanum lycopersicum* RubisCO small subunit 3C terminator (S/RbcS3Ct), Kanamycin Resistance gene (KanR).
Figure 11:
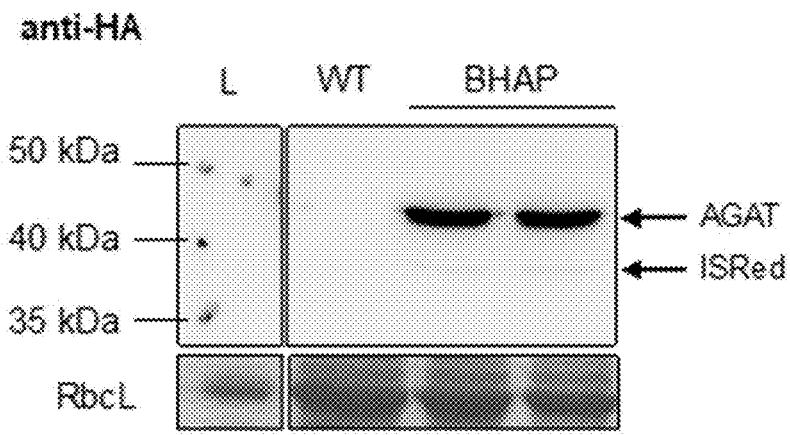
FIG. 11: Transient expression of BHAP T-DNA construct in N. benthamiana. Immunoblot analysis of N. benthamiana leaf discs transiently expressing the BHAP T-DNA construct for 5 days post infection with Agrobacteria. Enzyme expression was verified by using anti-HA-HRP antibody for the detection of AsGAT (43.90 kDa) and ISRed (35.09 kDa). Non-infiltrated leaves (WT) served as negative control.
Figure 12:
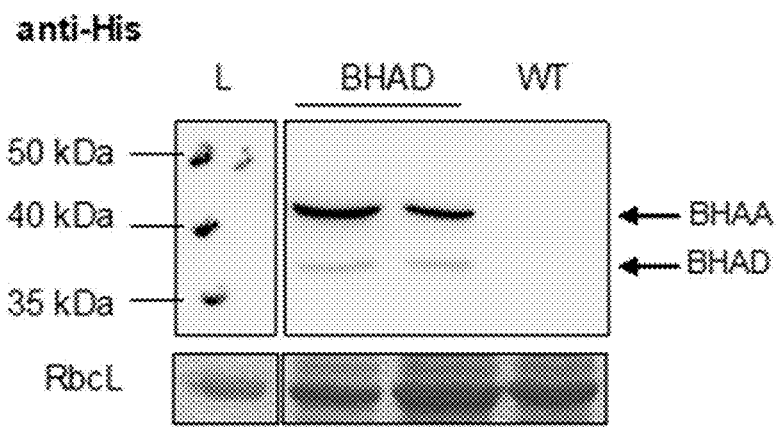
FIG. 12: Transient expression of BHAP T-DNA construct in N. benthamiana. Enzyme expression was verified by using anti-HIS-HRP antibody for the detection of BHAA (42.439 kDa) and BHAD (35.17 kDa). Non-infiltrated leaves (WT) served as negative control.

BHAP enzymes were individually tested for enzymatic activity in plant cell extracts of plant lines with transient expression of each enzyme, and compared to WT plant cell extracts. BHAP enzymes were transiently expressed in *N. benthamiana* leaf discs under the same photosynthetic promoter as contained in the multigene T-DNA construct for stable implementation of the BHAP in *Arabidopsis* (pMR228N, FIG. 9). As shown in FIGS. 4-7, the enzyme activity is clearly present in the transiently expressing plants and considerably higher than the background activity in WT plants. To differentiate the activity of IsRed from malate dehydrogenase activity, the formation of aspartate (via IsRed) and malate (via malate dehydrogenase) was quanti- Example 5—Multigene BHAP T-DNA Construct for in Planta Implementation and Verification of Construct Functionality The inventors constructed a multigene T-DNA nucleic acid construct for implementation of the BHAP in plants (FIG. 10). Although constitutive expression of multiple transgenes is a predominant approach in plants and might be of interest for future studies, the inventors use a fine-tuned approach of BHAP expression in plants. Within the multigene nucleic acid construct, each BHAP enzyme is expressed under its own photosynthetically regulated promoter, restricting BHAP expression to photosynthetic tissue and coupling BHAP expression to light and high photorespiratory metabolic flux. In our case, AsGAT is expressed under *Arabidopsis* chlorophyll A binding protein promoter (AT1g29930) and BHAA under the *Arabidopsis* RubisCO small subunit 2B promoter (AT5g38420). BHAD is expressed under the *Arabidopsis* RubisCO small subunit 1B promoter (AT5g38430) and ISRed expressed under the *Arabidopsis* RubisCO small subunit 3B promoter (AT5g38410). Moreover, the nucleic acid construct comprises terminator sequences operably linked to the nucleic acid sequence coding each polypeptide. These terminators are: *Agrobacterium tumefaciens* octopine synthase terminator (AtuOCSt, contained in SEQ ID NO 986, residues 2169-2882), *Agrobacterium tumefaciens* nopaline synthase terminator (AtuNOSt, contained in SEQ ID NO 986, residues 4773-5027), 35S terminator derived from the Cauliflower Mosaic Virus (35St, contained in SEQ ID NO 986, residues 6969-7172), *Solanum lycopersicum* RubisCO small subunit 3C terminator (SlRbcS3Ct, contained in SEQ ID NO 986, residues 9275-9556). Kanamycin resistance is used as selectable marker. Functionality of the T-DNA construct, regarding expression of all four enzymes was verified by transient expression in *N. benthamiana*, followed by immunoblot analysis (FIG. 11 and FIG. 12). *N. benthamiana* leaf discs transiently were infected with Agrobacteria to express the BHAP T-DNA construct, and were collected after 5 days for immunoblot analysis. Expression of the enzymes was verified by using anti-HA-HRP antibody for the detection of AsGAT (43.90 kDa) and ISRed (35.09 kDa). Anti-HIS-HRP antibody was used for the detection of BHAA (42.439 kDa) and BHAD (35.17 kDa). Non-infiltrated leaves (WT) served as negative control.

Example 6—BHAP Implementation in Plants

Figure 16:
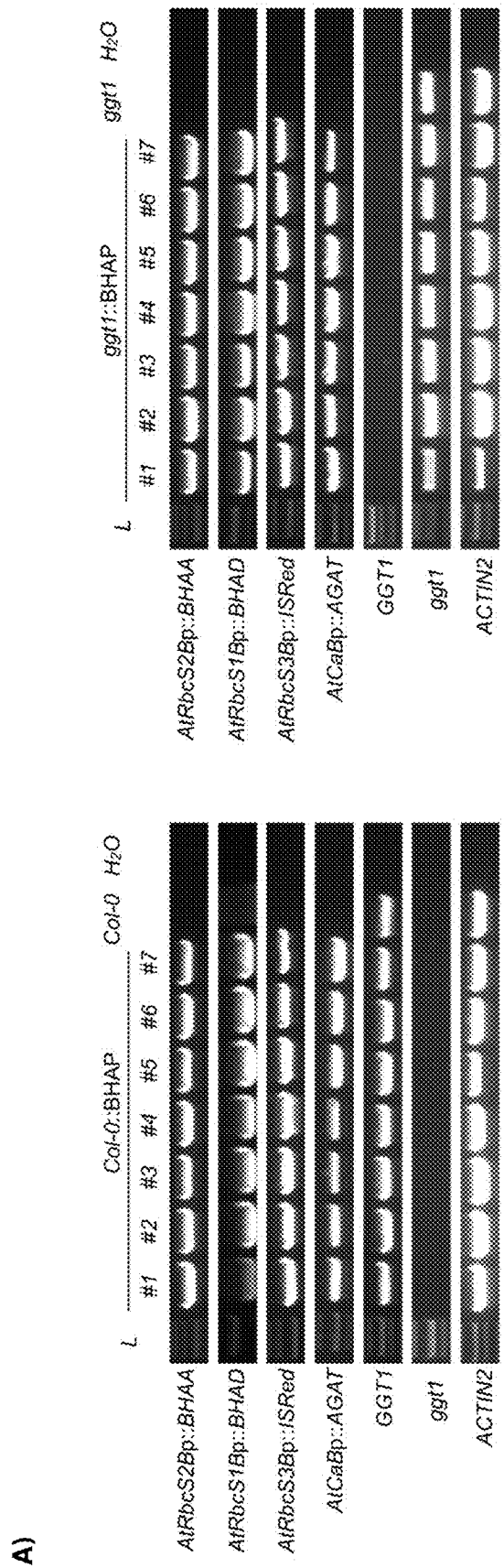
FIG. 16: BHAP implementation in *Arabidopsis* Col-0 and ggt1 mutant. A) Genomic DNA of seven independent primary transformants (#1-7) per background genotype was isolated and presence of the BHAP genes was verified using a promoter/coding sequence specific primer combination. ACTIN2 served as control to prove genomic DNA isolation. Homozygosity of the ggt1 mutant was confirmed using T-DNA specific primer and wildtype GGT1 gene served as control. B) Analysis BHAP implementation in *Arabidopsis* transformed lines with Col-0 and ggt1 background that were used in the experiments of Examples 7-9, FIGS. 17-23. CTRL1: Col-0, T-1: Col::BHAP #1, T-2: Col::BHAP #2, CTRL2: ggt1-1, T-3: ggt1-1::BHAP #1, T-4: ggt1-1::BHAP #2.
Figure 17:
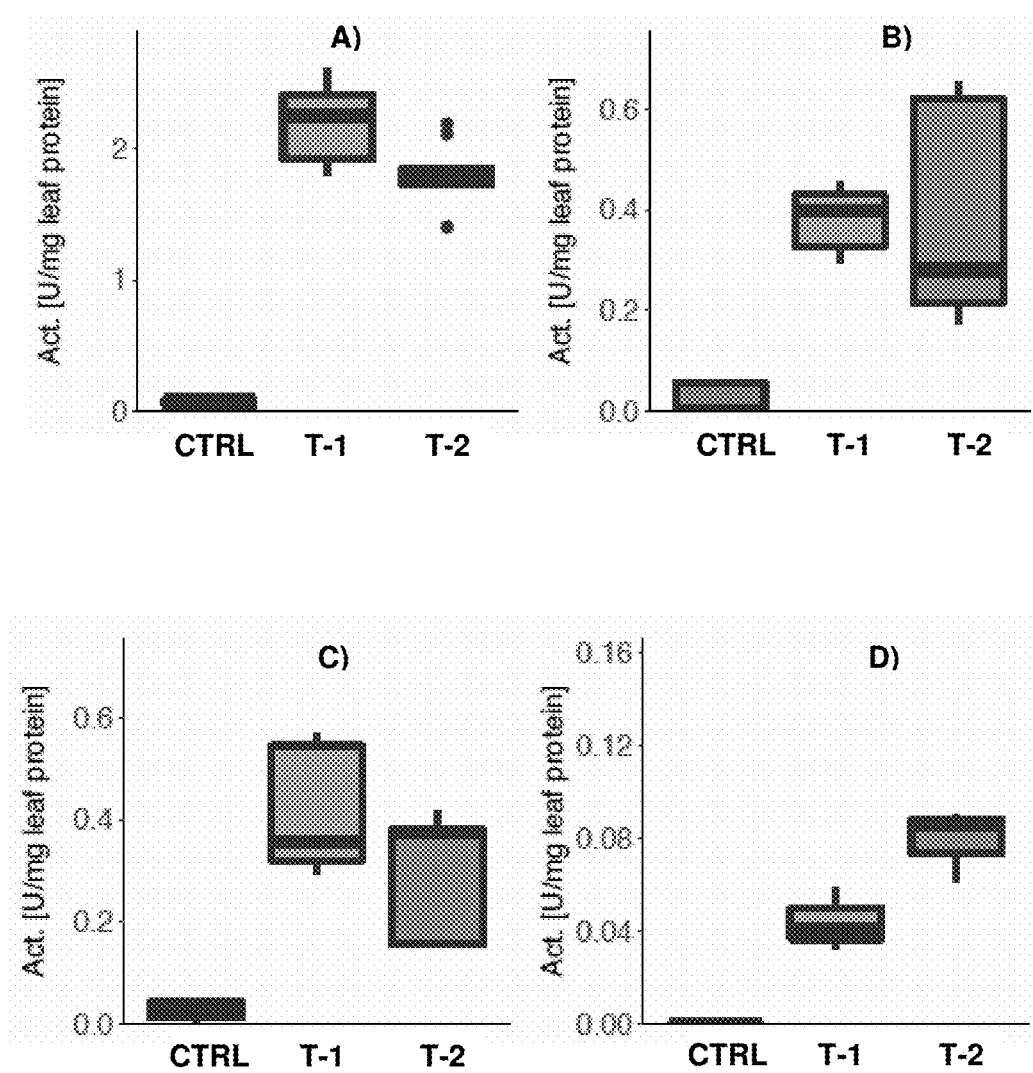
FIG. 17: shows the BHAP enzyme activity in transgenic *Arabidopsis* plants. BHAP enzyme activity was measured in total leaf extracts from 28 days old air-grown plants. A) aspartate:glyoxylate aminotransferase (AGAT), B) β-hydroxyaspartate aldolase (BHAA), β-hydroxyaspartate dehydratase (BHAD), D) Combined activities of BHAA, BHAD and ISR. E-G) ISR activity: E)$^{15}$N-aspartate, F) β-hydroxyaspartate, G) malate. The rate of $^{15}$N incorporation into aspartate was quantified over time. Rates of β-hydroxyaspartate and malate production are shown as control. CTRL: ggt1-1, T-1: ggt1-1::BHAP #1, T-2: ggt1-1::BHAP #2. Shown are mean±SD of three technical replicates.

*Arabidopsis* wildtype Col-0 was transformed with the generated BHAP T-DNA construct by floral dipping as described in the Methods. In order to facilitate high pathway flux via the BHAP, the synthetic pathway was also implemented in the *Arabidopsis* ggt1 mutant (GK-649H07). The ggt1 mutant is deficient in the peroxisomal glyoxylate: glutamate aminotransferase 1 (GGT1, At1g23310) and accumulates glyoxylate. The inventors verified complete BHAP implementation in *Arabidopsis* WT and ggt1 mutant by genotyping using for each BHAP enzyme a combination of forward and reverse primers specific for the promoter and the coding sequence, as described in the method section (FIG. 16). The established transgenic lines with the BHAP in WT and ggt1 mutant background were analyzed for phenotype, protein expression and enzymatic activity of all four BHAP enzymes (Examples 8 and 9).

These data strongly suggest that the BHAP can successfully be implemented also in other C3 plant, as oil, cereal, food or biomass crop (Table 8).

TABLE 8

Overview of potential plant species used for implementation of the BHAP. Notably, the crop species presented here are all C3 photosynthesis type crops where photorespiration plays a major role in limiting plant productivity.

| Scientific name | Common name | Purpose |
|---|---|---|
| *Helianthus annuus* | Sunflower | Oil crop |
| *Brassica napus* | Rapeseed/canola | Oil crop |
| *Camelina sativa* | Camelina | Oil crop |
| *Oryza sativa* | Rice | Cereal crop |
| *Hordeum vulgare* | Barley | Cereal crop |
| *Triticum* spp. | Wheat | Cereal crop |
| *Avena sativa* | Oat | Cereal crop |
| *Solanum lycopersicum* | Tomato | Food crop |
| *Solanum tuberosum* | Potato | Food crop |
| *Ipomoea batatas* | Sweet Potatoes | Food crop |
| *Glycine max* | Soybean | Food crop |
| *Beta vulgaris* | Sugar beet | Food crop |
| *Psidium guajava* | Common guava | Food crop |
| *Citrus limon* | Lemon | Food crop |
| *Mangifera indica* | Mango | Food crop |
| *Allium cepa* | Onion | Food crop |
| *Pisum sativum* | Pea | Food crop |
| *Secale cereale* | Roggen | Food crop |
| *Canavalia ensiformis* | Jack bean | Food crop |
| *Medicago sativa* L. | Alfaalfa | Food crop |
| *Prunus amygdalus* L. | Almond | Food crop |
| *Phaseolus vulgaris* L. | Bean | Food crop |
| *Malus* spp. | Apple | Food crop |
| *Prunus armeniaca* L. | Apricot | Food crop |
| *Asparagus officinalis* L. | Asparagus | Food crop |
| *Persea american* P.mill. | Avocado | Food crop |
| *Musa sapientum* L. | Banana | Food crop |
| *Brassica oleracea* L. | Cabbage | Food crop |
| *Daucus carota* L. | Carrot | Food crop |
| *Anacardium occidentale* L. | Cashew | Food crop |
| *Cicer arietinum* L. | Chickpea | Food crop |
| *Theobroma cacao* L. | Cocoa | Food crop |
| *Vigna unguiculata* | Cowpea | Food crop |
| *Vaccinium macro carpon* | Cranberry | Food crop |
| *Cucumis sativus* L. | Cucumber | Food crop |
| *Solanum melongena* L. | Eggplant | Food crop |
| *Vicia faba* L. | Faba bean | Food crop |
| *Ficus carica* L. | Fig | Food crop |
| *Linum usitatissimum* L. | Flaxseed | Food crop |
| *Vitis vinifera* L. | Grape | Food crop |
| *Lactuca* spp. | lettuce | Food crop |
| *Phaseolus lunatus* L. | Lima bean | Food crop |
| *Beta vulgaris* L. | Mangold | Food crop |
| *Olea europea* L. | Olive | Food crop |
| *Citrus sinensis* L. | Orange | Food crop |

TABLE 8-continued

Overview of potential plant species used for implementation of the BHAP. Notably, the crop species presented here are all C3 photosynthesis type crops where photorespiration plays a major role in limiting plant productivity.

| Scientific name | Common name | Purpose |
|---|---|---|
| *Petroselium crispum* | Parsley | Food crop |
| *Prunus persica* L. | Peach | Food crop |
| *Arachis hypogea* L. | Peanut | Food crop |
| *Pyrus communis* L. | Pear | Food crop |
| *Carya illinoinensis* | Pecan | Food crop |
| *Capsicum* spp. | Pepper | Food crop |
| *Cajanus cajan* | Pigeonpea | Food crop |
| *Prunus* spp. | Plum | Food crop |
| *Gossypium hirsutum* L. | Cotton | Fiber crop |
| *Ocimum tenuiflorum* | Tulsi | Medicinal crop |
| *Ricinus communis* L. | Castor bean | Medicinal crop |
| *Taraxacum officinale* | Dandelion | Medicinal crop |
| *Nicotiana tabacum* | Tobacco | Biomass crop |
| *Arabidopsis thaliana* | Thale cress | Scientific research |

Example 7—Establishing Transgenic BHAP Plant Lines

The inventors verified BHAP implementation in *Arabidopsis thaliana* WT Col-0 (FIG. 21) and ggt1 mutant (FIGS. 17-23) on a genomic level. Stable BHAP plant lines were tested for BHAP activity. This included the identification of two independent T-DNA lines per genotype expressing all four BHAP enzymes, i.e. BHAP #1 and #2, using immunoblot analysis. The established lines were segregated for homozygous T-DNA insertion and in vitro BHAP enzyme activity was successfully demonstrated using the previously established assays described in the Method section and in Example 4 (FIG. 17A-G). Thus, stable BHAP plant lines expressing all four enzymes of the BHAP in an active form were identified.

Example 8—Phenotypic Analysis of BHAP Plants

Figure 18:
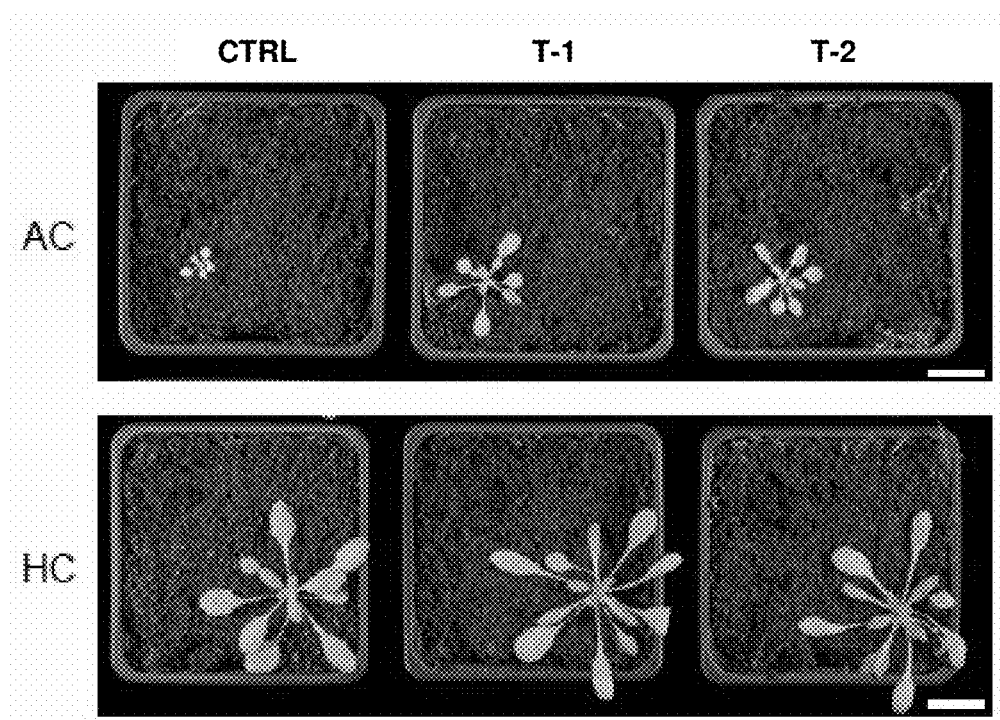
FIG. 18: Phenotype of *Arabidopsis* plants containing the peroxisomal BHAP. A) Plants were grown either in air (400 ppm $CO_2$, AC) or under non-photorespiratory conditions (3000 ppm $CO_2$, HC) in a 12 h light/12 h dark rhythm. Phenotype of plants containing the BHAP in the ggt1-1 mutant background compared to negative control plants. CTRL: ggt1-1, T-1: ggt1-1::BHAP #1, T-2: ggt1-1::BHAP #2. Images were taken 28 days after transfer to light. Scalebar=2 cm.
Figure 19:
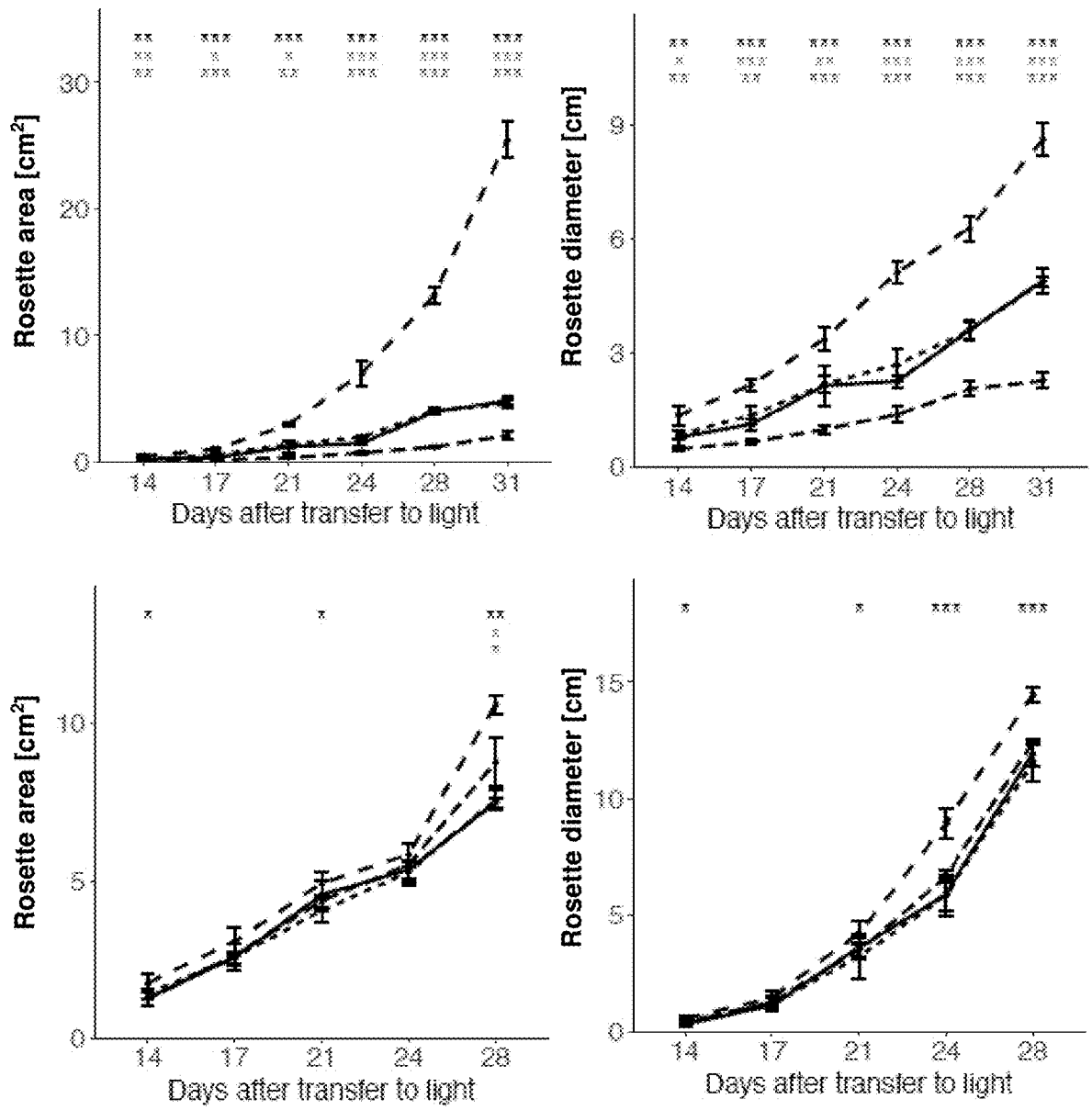
FIG. 19: Phenotype of *Arabidopsis* plants containing the peroxisomal BHAP. Quantification of growth of BHAP-containing plants. Rosette area and rosette diameter were measured over time. CTRL1: Col-0, CTRL2: ggt1-1, T-1: ggt1-1::BHAP #1, T-2: ggt1-1::BHAP #2. Plants were grown either at 3000 ppm $CO_2$ (HC, second row), 400 ppm $CO_2$ (AC, first row). Student's t-test was performed against the ggt1-1 mutant. Asterisks represent the test results for the respective genotype. $p<0.05=*$, $p<0.01=$, $<0.001=*$. n=5.
Figure 20:
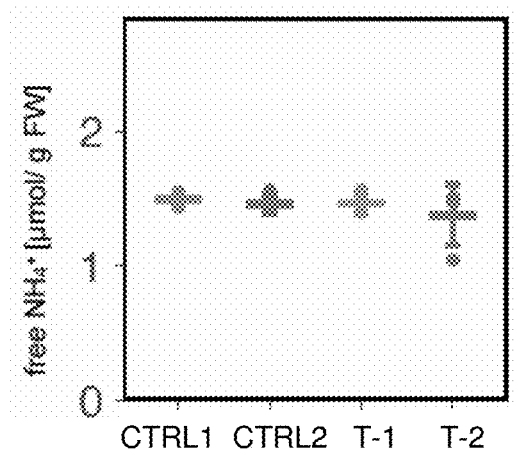
FIG. 20: Quantification of free ammonium in green tissue of 14 days old seedlings. *Arabidopsis* plants were harvested in the middle of the light phase. Plants were grown either at 3000 ppm $CO_2$ (HC), 400 ppm $CO_2$ (AC) or shifted from 3000 ppm $CO_2$ to 400 ppm $CO_2$ three days prior harvest (Shift). CTRL1: Col-0, CTRL2: ggt1-1, T-1: ggt1-1::BHAP #1, T-2: ggt1-1::BHAP #2. Student's t-test against the ggt1-1 mutant. Asterisks represent the test results for the respective genotype. $p<0.05=p<0.01=$, $<0.001=*$. n=4.
Figure 20:
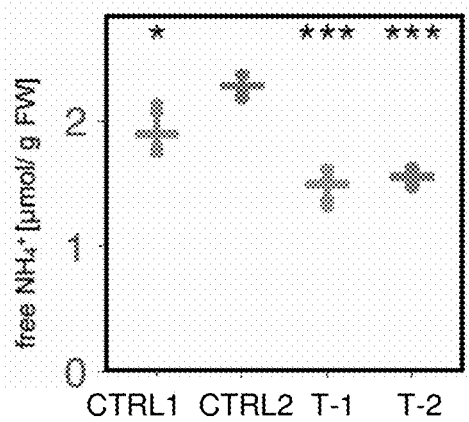
Figure 20:
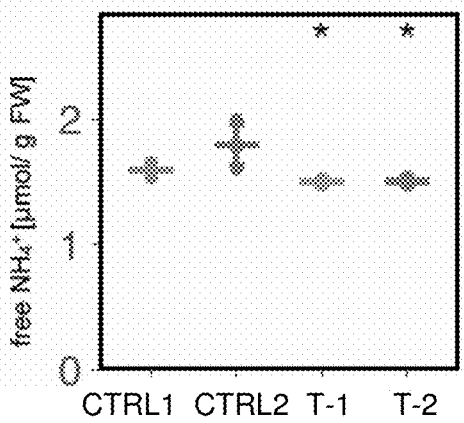

The physiological consequences of the BHAP, as $CO_2$ neutral photorespiratory bypass, were tested by analyzing the phenotype of the established BHAP *Arabidopsis thaliana* plants. This included the quantification of phenotypic parameters like plant growth, rosette size and leaf size, as well as the measurement of free ammonium in green tissue. In all cases, the transgenic plants engineered with the BHAP performed markedly better than the ggt1 mutant (background), which was used as negative control (FIGS. 18, 19, and 20).

Example 9—Metabolomic Analysis of BHAP Plants

Figure 21:
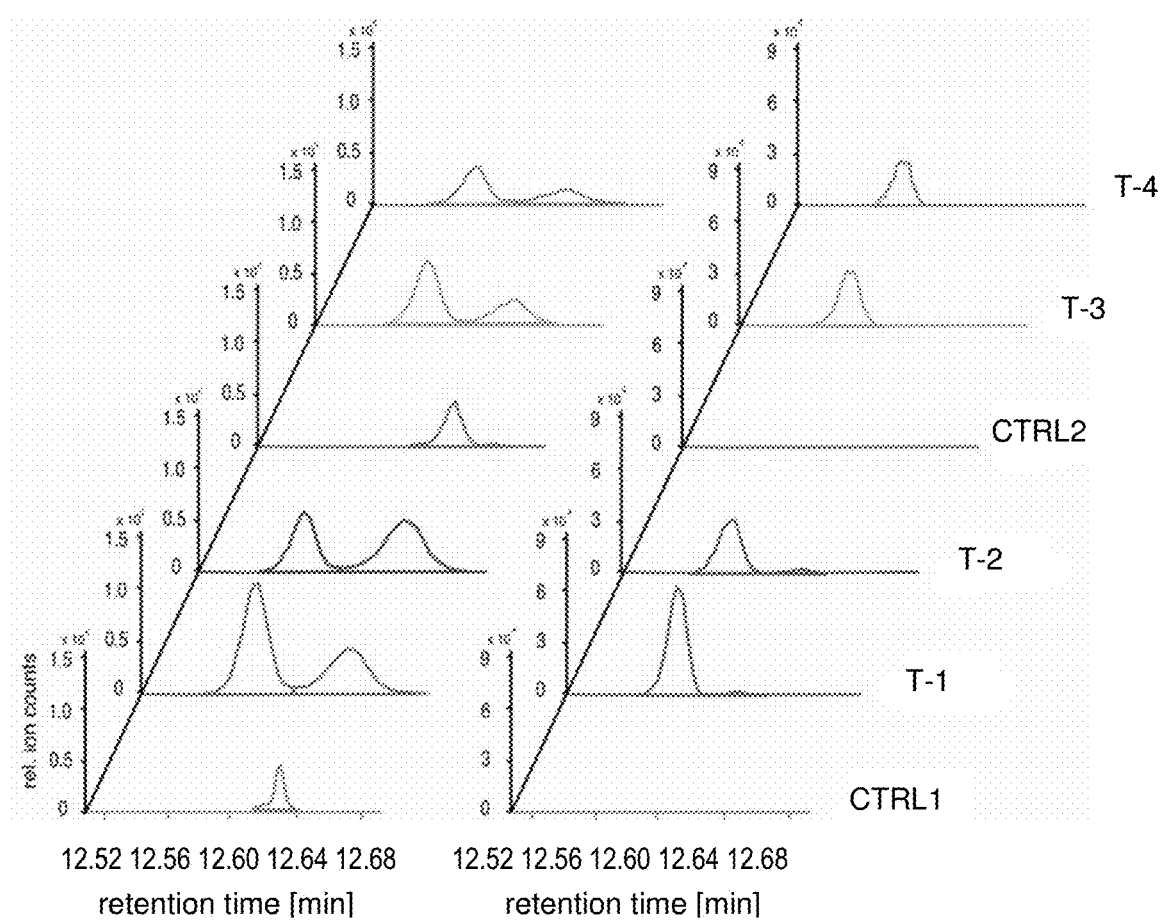
FIG. 21: Metabolite profiling. Representative extracted ion chromatogram for the masses 281.1023 (graphs on left), and 292.1346 (graph on right). CTRL1: Col-0, T-1: Col::BHAP #1, T-2: Col::BHAP #2, CTRL2: ggt1-1, T-3: ggt1-1::BHAP #1, T-4: ggt1-1::BHAP #2.
Figure 22:
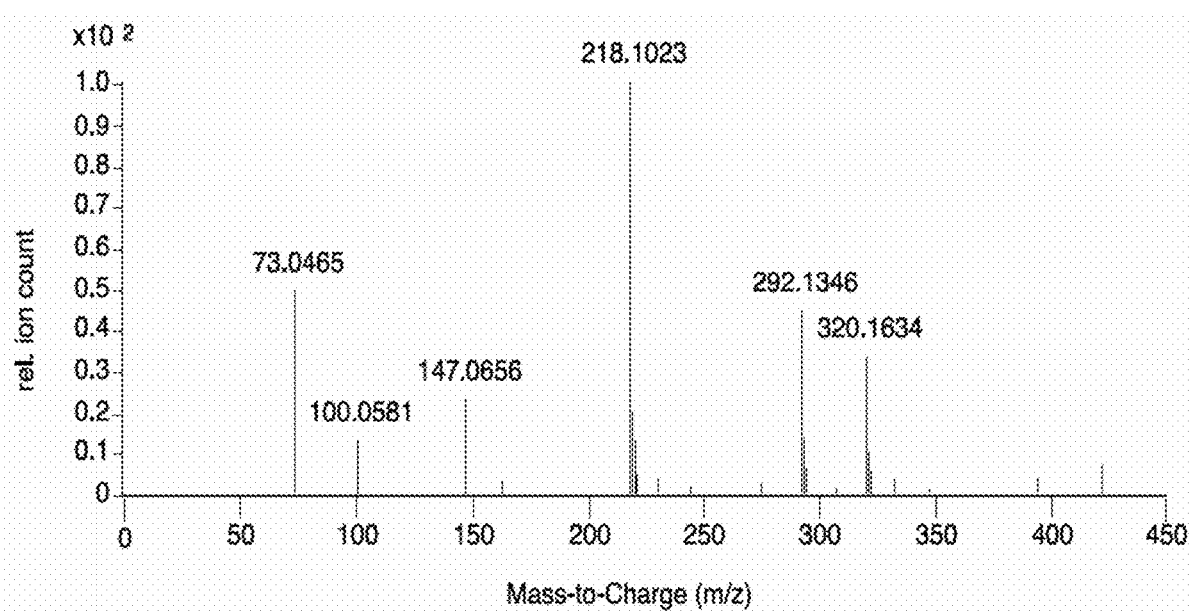
FIG. 22: Metabolite profiling. Deconvoluted mass spectrum of β-hydroxyaspartate.
Figure 23:
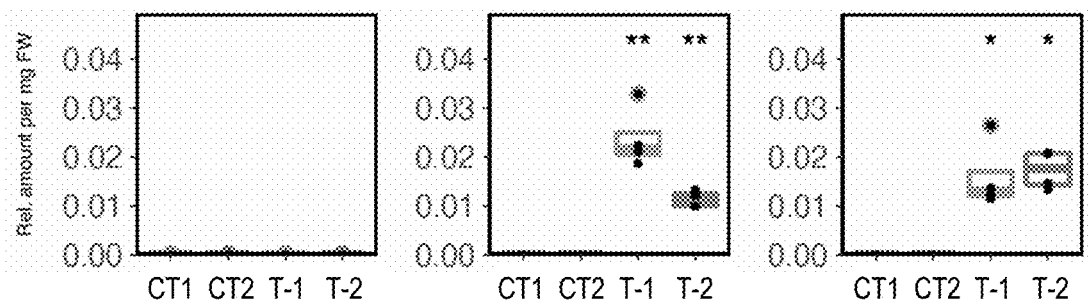
FIG. 23: Metabolite profiling. Relative metabolite levels of (A) β-hydroxyaspartate, (B) glycine, (C) aspartate and (D) malate. Green tissue of 14 days old seedlings was harvested in the middle of the light phase. Plants were grown either at 3000 ppm $CO_2$ (HC, left graph), 400 ppm $CO_2$ (AC, middle graph) or shifted from 3000 ppm $CO_2$ to 400 ppm $CO_2$ three days prior harvest (Shift, right graph). CT1: Col-0, CT2: ggt1-1, T-1: ggt1-1::BHAP #1, T-2: ggt1-1::BHAP #2. Student's t-test against ggt1-1 mutant. Asterisks indicate significance after multiple testing correction using Benjamini-Hochberg. $p<0.05=*$, $p<0.01=$, $p<0.001=*$. n=4.
Figure 23:
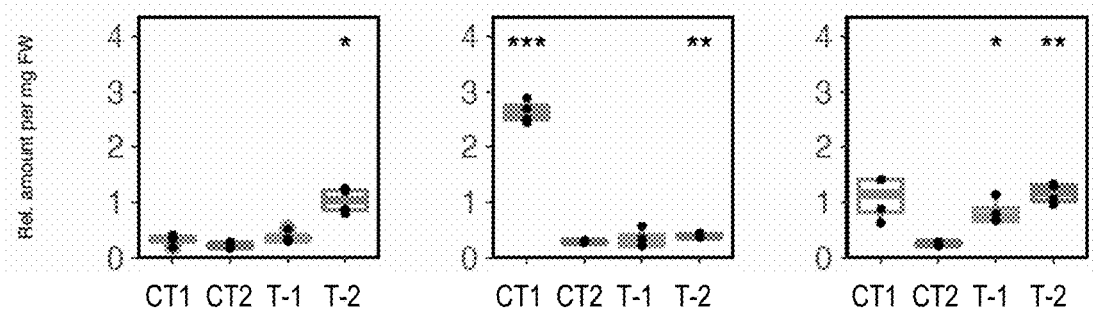
Figure 23:
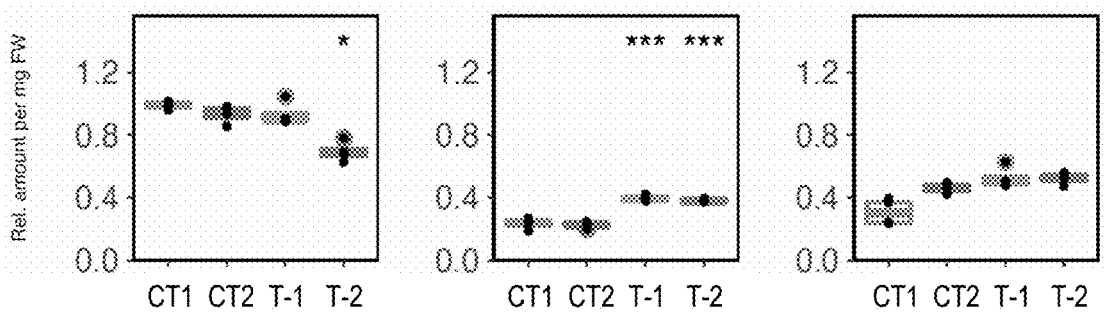
Figure 23:
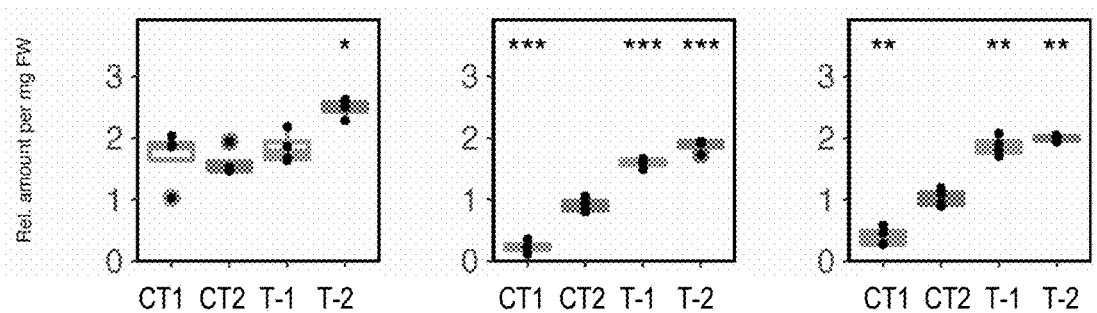

Metabolic flux through the BHAP was tested by quantifying cellular aspartate levels, as BHAP intermediate, and malate levels as described in the Method section. As expected, aspartate and malate levels were significantly increased in plant lines engineered with the BHAP under photorespiratory conditions (FIG. 23C, D). To analyze the metabolic effects of the BHAP on photorespiratory metabolism, the levels of glycine (FIG. 23B) were also analyzed. Furthermore, β-hydroxyaspartate as a unique metabolite of the BHAP was successfully identified in transgenic plant lines, while this compound was completely absent in negative control lines (FIGS. 21-23). This demonstrates unequivocally that the BHAP is indeed operating in these transgenic plant lines.

Example 10—Gas Exchange Measurements in BHAP Plants

In order to confirm the improved carbon efficiency of BHAP plants photorespiratorily released $CO_2$ will be measured by gas exchange and quantified as described by (Long, S P and Bernacchi, CJ Journal of Experimental Botany 2003). A lowered photorespiratory $CO_2$ loss will be observed in BHAP plants. Furthermore, respiratory $CO_2$ release will be determined to exclude enhanced respiratory $CO_2$ release in BHAP plants. The improved carbon efficiency of the BHAP plants results in a lowered $CO_2$ compensation point.

Example 11—BHAP Implementation in Plants Cytoplasm, Chloroplast or Mitochondria

The implementation of BHAP in cellular compartments such as mitochondria, chloroplast and cytosol is possible and of interest.

The implementation of BHAP in plant cell cytosol can be accomplished by targeting BHAP enzymes to the cytosol using the nucleotide sequences coding the polypeptides with the enzymatic activities (a)-(d) without a specific organellar targeting sequences (IsRed: SEQ ID NOs 908 and 909, BHAA: SEQ ID NOs 910 and 911, BHAD: SEQ ID NOs 912 and 913, and AsGAT: SEQ ID NOs 914 and 915).

As glyoxylate is low in chloroplast and mitochondria, the establishing of the BHAP requires the expression of glycolate dehydrogenase (EC 1.1.99.14) (enzymatic activity (e)) for glyoxylate production, fused to chloroplast or mitochondria targeting sequences.

Thus, establishing the BHAP in mitochondria requires only one additional gene for functionality, since produced oxaloacetate is directly metabolized by the TCA cycle.

BHAP expression in chloroplasts requires further an ATP-dependent phosphoenolpyruvate carboxykinase (PEPCK, EC 4.1.1.49) (enzymatic activity (f)) for downstream metabolism of oxaloacetate. Oxaloacetate produced by the BHAP will be decarboxylated by PEPCK and generated phosphoenolpyruvate will be converted into 2-phosphoglycerate by plastidial enolase, ENO1 (At1g74030 (http://doi.wiley.com/10.1016/j.febslet.2009.02.017)) and further into 3-phosphoglycerate by plastidial phosphoglycerate mutase (PGM, At5g51820). Produced 3-phosphoglycerate subsequently enters photosynthetic carbon metabolism. Although the decarboxylation of oxaloacetate in the chloroplast might positively influence $CO_2$ assimilation, the PEPCK step requires one ATP per produced phosphoenolpyruvate, thereby weakening the energy-conserving principle of the BHAP. Furthermore, produced PEP might be distributed between 3-phosphoglycerate production and the shikimate pathway for aromatic amino acid biosynthesis. Alternatively, oxaloacetate is reduced by a NAD(P)-dependent malate dehydrogenase to produce malate that can be exported from the chloroplast via Dit1 (At5g12860).

Therefore, the implementation of BHAP in plant cell mitochondria can be accomplished by targeting BHAP enzymes to the mitochondria using the nucleotide sequences coding the polypeptides with the enzymatic activities (a) erythro-β-hydroxyaspartate aldolase, (b) erythro-β-hydroxyaspartate dehydratase, (c) iminosuccinate reductase, (d) aspartate-glyoxylate transaminase, and (e) glycolate dehydrogenase fused to a N-terminal targeting sequence such as the serine hydroxymethyltransferase 1 (At4g37930) (SEQ ID No 919).

The implementation of BHAP in plant cell chloroplast can be accomplished by targeting BHAP enzymes to the chloroplast using the nucleotide sequences coding the polypeptides with the enzymatic activities (a) erythro-β-hydroxyaspartate aldolase, (b) erythro-β-hydroxyaspartate dehydratase, (c) iminosuccinate reductase, (d) aspartate-glyoxylate transaminase, (e) glycolate dehydrogenase, and (f) phosphoenolpyruvate carboxykinase fused to a N-terminal targeting sequence such as the *Arabidopsis* ferredoxin-2 (At1 g60950) (SEQ ID No 917).

Example 12—Implementing the BHAP as a Heterologous Photorespiration Bypass Pathway into Cyanobacteria The four genes of the BHAP were successfully integrated at two different neutral sites of the *S. elongatus* PCC7942 chromosome. This was done both in the WT strain and in a deletion strain that lacks the genes necessary for the formation of carboxysomes (ccmK-O), and therefore requires elevated atmospheric $CO_2$ concentrations for growth (this strain is henceforth referred to as ΔK-O). Subsequently, successful expression of the pathway enzymes was verified by measuring enzyme activities in cell-free extracts.

Figure 13:
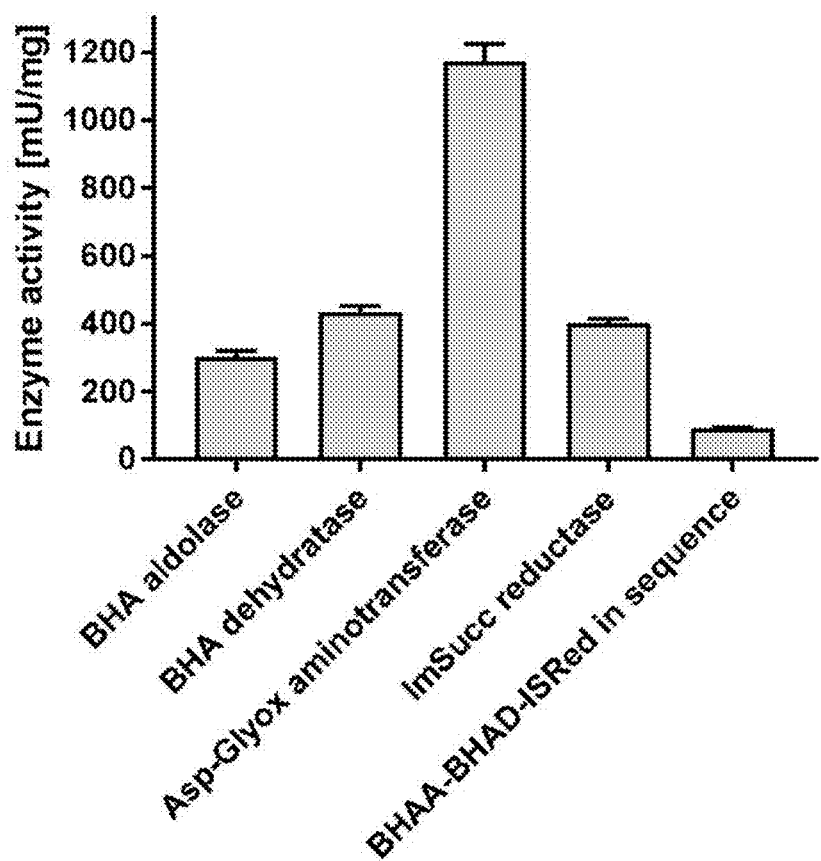
FIG. 13: shows the activities of BHAP enzymes measured in cell-free extracts of *S. elongatus* PCC7942 ΔK-O. To determine the single enzyme activities, required coupling enzymes were added in excess. The rightmost bar shows the activity of the BHAA-BHAD-ISRed reaction sequence, measured without additional coupling enzymes. The average of three replicates is shown; error bars represent standard deviations.

As shown in FIG. 13, the activity of each single enzyme in the ΔK-O strain was at least 300 mU/mg, while the reaction sequence from glycine and glyoxylate to aspartate (via BHA aldolase, BHA dehydratase and iminosuccinate reductase) was measured at an activity of ~100 mU/mg, notably without any additional coupling enzymes. It can therefore be assumed that the expression level of the BHAP enzymes is high enough to sustain photorespiratory flux in *S. elongatus* PCC7942 ΔK-O.

Figure 14:
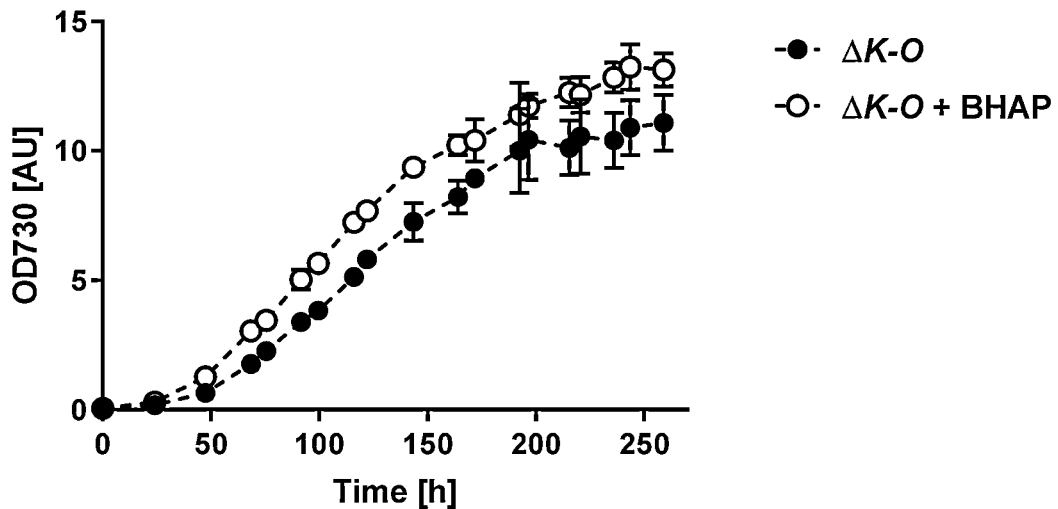
FIG. 14: shows the Growth curves of engineered cyanobacterial strains at 30° C. Three replicate cultures of each strain were grown in a light incubator in an atmosphere containing 0.5% $CO_2$. Samples were taken twice each day, and $OD_{730}$ was measured manually in a spectrophotometer after suitable dilution. The average of three replicates is shown; error bars represent standard deviations.
Figure 15:
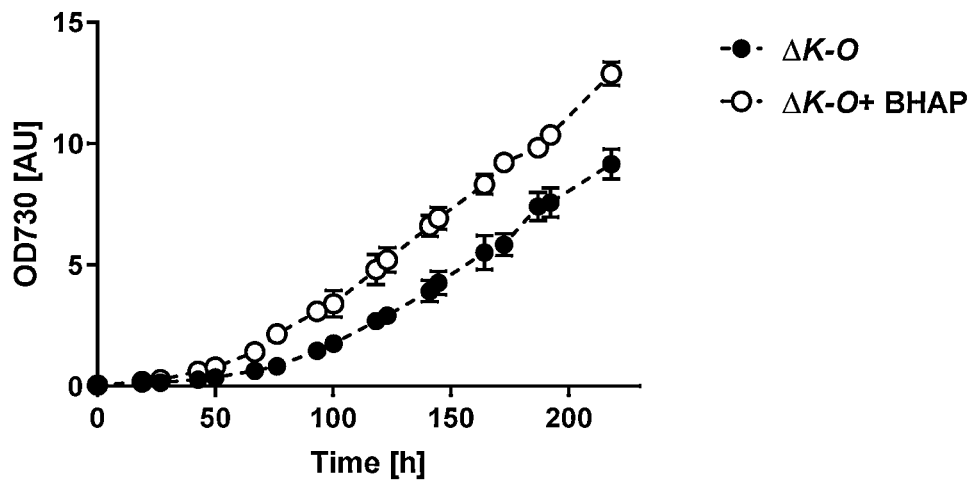
FIG. 15: shows the Growth curves of engineered cyanobacterial strains at 37° C. Three replicate cultures of each strain were grown in a light incubator in an atmosphere containing 0.5% $CO_2$. Samples were taken twice each day, and $OD_{730}$ was measured manually in a spectrophotometer after suitable dilution. The average of three replicates is shown; error bars represent standard deviations.

Next, it was tested whether the implementation of the BHAP in the ΔK-O background conferred a specific phenotype due to improved capabilities for photorespiration. To this end, three replicate cultures (50 mL in baffled shake flasks) of each strain were grown at 30° C. in a light incubator in an atmosphere containing 0.5% $CO_2$, and growth curves were recorded. This experiment was independently repeated three times; FIG. 14 shows representative growth curves from one of the three experiments. The same experiment was also conducted once at 37° C. to investigate the effect of elevated temperature on photorespiration; the results are shown in FIG. 15.

For all experiments, the slope of the growth curves during the linear growth phase was determined. As shown in Table 9, implementation of the BHAP in the ΔK-O background resulted in significantly increased slopes compared to the control strain in all cases. Taken together, these results confirm that implementation of the BHAP in the ΔK-O background permits faster growth of the engineered strain.

TABLE 9

Slopes derived from cyanobacterial growth curves. Suitable intervals of the growth curves were fitted with linear regression. The average slope ± standard deviation of three replicates is given, and it was compared whether the slopes of the two strains were significantly different in each experiment.

| Experiment | Interval for linear regression [h] | Slope ΔK-O | Slope ΔK-O + BHAP | Significant difference? |
|---|---|---|---|---|
| 30° C., I | 80-190 | 0.080 ± 0.002 | 0.096 ± 0.003 | Yes; p = 0.0004 |
| 30° C., II | 45-140 | 0.070 ± 0.002 | 0.086 ± 0.001 | Yes; p < 0.0001 |
| 30° C., III | 45-125 | 0.076 ± 0.002 | 0.092 ± 0.002 | Yes; p = 0.0002 |
| 37° C. | 90-190 | 0.062 ± 0.002 | 0.074 ± 0.001 | Yes; p < 0.0001 |

Example 13—Alternative Approaches for BHAP Implementation in Plants

An alternative to the detailed expression of the BHAP under photosynthetic promoters is the constitutive active expression using the *Agrobacterium* NOS (SEQ ID No: 924) and MAS promoter (SEQ ID No: 925), the cauliflower mosaic virus 35S promoter (SEQ ID No: 926) and the *Arabidopsis* UBIQUITIN10 promoter. This approach allows BHAP expression in photosynthetic and heterotrophic tissue as well as a time/light independent expression. It is worth mentioning that the implementation of non-native plant promoters increases potential effects of post-transcriptional gene silencing.

Example 14—Implementation of BHAP in *Nicotiana tabacum*

The enzymes of the BHAP are successfully expressed in *Nicotiana tabacum* using the above-described plant transformation methods. Enzyme activity of each BHAP enzyme is maintained in *Nicotiana tabacum*.

Example 15—Characterization of BHAC Enzymes from Other Bacterial Species 5 enzymes each are chosen from the provided list of iminosuccinate reductase sequences (SEQ ID 1-299) and aspartate-glyoxylate aminotransferase sequences (SEQ ID 300-599). These enzymes are cloned, expressed, and purified according to the protocols described in the Methods section. Subsequent enzymatic assays demonstrate that these BHAC enzymes from other bacterial species indeed have the respective activity of iminosuccinate reductases or aspartate-glyoxylate aminotransferases, as suggested. Their kinetic parameters are largely in accordance with the previously measured parameters of the enzymes from *Paracoccus denitrificans*. These results underline that the provided list of sequences indeed contains a multitude of enzymes with the proposed activities, which could be used in various combinations to engineer a functional BHAC into plant hosts.

SEQUENCE LISTING (986 sequences)

SEQ ID NO: 1 - protein, 292 aa, Silicibacter pomeroyi DSS-3 megaplasmid
MAAGTARNFPVIREAIGHADALYGFKSGFDRQALNLGLKSGGYWPGNADKGLTNHQSTVFLFDADTGRCQAVVGGNLLTALRTAAASSVSIKHLARQDAKVIGMIGAGHQAKFQLRAALEQRNFEKVIGWNLHPEMLVNLQEVADEAGLPFEAVELDGMREADVIITITSSFDAILKADQVSPGTHIACMGTDTKGKQEVDPQLLVMADVFTDEVAQSISIGEAQHAVAHGLIQAADVAQIGAVINGTNPGRTSDAQITLFDGTGVGLQDLAVAATVVERARAAGAGTEIAF

SEQ ID NO: 2 - protein, 321 aa, Silicibacter sp. TM1040
MYIVPERVIADLMTREAAFDAVEKVFAAMAAEDAYNFPVVREAIGHEDALYGFKGGFDRAGLTLGLKAGGYWPHNLEKRGQINHQSTVFLFDPDTGKAHAMVGGNLLTALRTAAASSVSIKHLARDDAKVIGMIGAGHQATFQLRAALEQRNFEKVIGWNLHPEMLPNIEAVAAEAGLPFEAVELDGMRAADVIISITSSFEASLMADHVSPGTHIACMGTDTKGKQEVDPALLVRAEVFTDEVAQSVGIGEAQHAVAQGLIEAADLTQLGAVINGAHPGRSTDDQITLFDGTGVGLQDLAVAARVVELAVTQGIAMEVDF

SEQ ID NO: 3 - protein, 321 aa, Loktanella vestfoldensis SKA53
MIIVPEKEIAGLMTRADAYNAVEQVFASMSSGRAYNFPVIREAIGHADALYGFKSGFDRDGLALGLKSGGYWPGNEANGLTNHQSTVFLFDADTGKCRAIVGGNLLTALRTAAASAVSINHLARKDASVLGMIGAGHQSVFQLRAAVEQRSFDKIIGWNYHPEMLQRLAAVAAELGIPFEAVSLAQLGAEADVIISITSAFAPSLLDIHVRPGTHIACMGTDTKGKQELEAAVLARATVFTDEVAQAVTIGEAQHAIAAGLITQDAIHEMGAVVNGTHPGRTSPDEITVFDGTGVGLQDLAVASAVVDLAVAKGVATTVEF

SEQ ID NO: 4 - protein, 320 aa, Paracoccus denitrificans PD1222 chromosome 2
MLVVAEKEIAGLMTPEAAFEAIEAVFASMARRKAYNFPVVREAIGHEDALYGFKGGFDASALVLGLKAGGYWPNNQKHNLINHQSTVFLFDPDTGRVSAAVGGNLLTALRTAAASAVSIKYLAPKGAKVLGMIGAGHQSAFQMRAAANVHRFEKVIGWNPHPEMLSRLADTAAELGLPFEAVELDRLGAEADVIVSITSSFSPLLMNEHVKGPTHIAAMGTDTKGKQELDPALVARARIFTDEVAQSVSIGECQHAIAAGLIREDQVGELGAVVAGDDPGRGDAEVTIFDGTGVGLQDLAVAQAVVELAKHKGVAQEVEI

SEQ ID NO: 5 - protein, 325 aa, Roseobacter denitrificans OCh 114
MSKGLLIVGEDICAEVVSSADAFTAVEAVFGAMAKGDAYNFPVIREAIGYADALYGFKSGFDKAGKTLGVKSGGYWPGNMDKGLTNHQSTIFLFDPDTGMLEALVGGNYLTAVRTAASSSVSIAHLARKDAKVLGMVGAGHQSTFQLRAAAEQRDFEKVVAWNPHPDMLPRLGAVAEELGLAFEAVTQEELGAQADVIITITSAFEPLLMKDWIKPGTHIACMGTDTKGKQEVDPELLVSATVFADEIAQSVTIGEAQHAVASGRLSDAEITPIGAVINGTHAGRSSDQQITLFDGTGVGLQDLAVASVAAREAESRGKATRIAL

SEQ ID NO: 6 - protein, 321 aa, Ahrensia sp. R2A130 contig00014
MIIVPEKEIGGLVTREAAFDAVESVFAAMASGDAYNFPVIREAIGHVDALYGFKGGFDKAGMSLGLKAGGYWPNNLDTKGIINHQSTVFLFDPDTGQVSAMVGGNLLTALRTAAASSVSIKHLARKDAKVLGMIGAGHQAKFQLRTALEHRDFEKVIGWNLHPEMLPNLEEVAAEAGLPFEAVELSGMTEADVIITITSSFDATMMGDHVAPGTHVACMGTDTKGKQEVGVDLIAKATLFADEIAQSISIGECQHAIADGSIKEADITPIGAVINGTHTGRMSDDEITLFDGTGVGLQDLAVASAAVVLAKAQGKAIEVEL

SEQ ID NO: 7 - protein, 330 aa, Dinoroseobacter shibae DFL-12
MLQKPDTDGLVIVTEEICQKVIDRDLAFAAVRDVFGAMARGDAYNFPVIREAIGHEDALYGFKSGFDKAGMVLGVKAGGYWPNNMAKGIINHQSTVFLFDPDTGKLKALVGGNYLTAIRTAASSAVSIDQLARKDAKVLGMVGAGHQSTFQLRAAVEQRDFEKVVCWNPHPDMIPNLGKVAAEIGIPFEAVSREELGAQSDVIITITSAFEPLIEAGYIKPGTHLACMGTDTKGKQEVAAELVAKATLFTDEVAQSTTIGETQHAIASGAITQDDVTPIGKVINGDHPGRTSDDEITLFDGTGVGLQDLAVAAVAAEQAVATGAATRVSL

SEQ ID NO: 8 - protein, 321 aa, Octadecabacter arcticus 238
MYIVPESAIADILTRPDAFNAVEQVFAAMSAGVAYNFPVIREAIGHEEALYGFKGGFDGKGMSLGLKAGGYWPHNLEKRGIINHQSTVFLFDPDTGKVAAMVGGNLLTALRTAAASSVSIKHLARKDSKVMGMIGAGHQAKFQLRHALETHSFEKVIGWNYHPEMLPSLAEVAAEFDLPFEAVTLEGMTEADVVISMTSSFNPIFGAAHISDGTHIACMGTDTIGKQECETDLIVKATVFTDEVAQSVTLGETQHAVSAGLKSRDDIFELGAVINGTHAGRTSDREITLFDGTGVGLQDLAVAASIVEIAKAKGIGMDVDF

SEQ ID NO: 9 - protein, 321 aa, pDaep_A276
MYIVPEKAVADLVTREASFDAVEKVFAAMASGDAYNFPVVREAIGHEDALYGFKGGFDRAGLTLGLKAGGYWPNNLEKRGLINHQSTVFLFDPDTGKVKAMVGGNLLTALRTAAASSVSIKHLARQGAKVIGMIGAGHQATFQLRAALEQRPFEKVIGWNYHPEMLPNIEKVAAEAGVPFEAVDLPGMADADVIISITSAFAPSLMADHVSPGTHIACMGTDTKGKQEVEAELLVKATVFTDEVAQSISIGEAQHAVAQGLIQESDVAQIGAVINGTNPGRTSDDQITLFDGTGVGLQDLAVAASVVEVALEKGIAIEVDF

SEQ ID NO: 10 - protein, 320 aa, Paracoccus sp. J56
MYVVAEKEIAGLMNPEAAFEAIEAVFAAMARRKAYNFPVVREAIGYEDALYGFKGGFDASGLALGLKAGGYWPNNQKHGLINHQSTVFLFDPDTGRVSAAVGGNLLTALRTAAASAVSIKYLAPKGAKVLGMIGAGHQSAFQMRAAANVHGFEKVIGWNPHPEMLSRLADTAAELGLPFEAVDLPQLGEEADVIISITSSFSPLLLNEHVKGPTHIAAMGTDTKGKQELDPALVTRARIFTDEVAQSISIGECQHAIAAGLIKEEQISELGAVVTGDNPGRADAEVTLFDGTGVGLQDLAVAQKVLEIAKEKGIAQQVEI

SEQ ID NO: 11 - protein, 331 aa, Paracoccus aminophilus JCM 7686
MAGFSTRKGLLMYIVAEKEIAGLMTPAAAFEAIEAVFAAMAARKAYNFPVVREAIGYEDALYGFKGGFDGAALTLGLKAGGYWPNNQKHNLINHQSTIFLFDADTGRAKAAIGGNLLTALRTAAASAVSIKYLAPKGAKVLGMIGAGHQSAFQMKAAAAVHSFEKVIGWNPHPEMLTRLAETAAGLGLPFEAVELDRLGAEADVIISITSAFSPLLMDAHVKGETHIAAMGTDTKGKQELDPALVARARIFTDEVAQSISIGETQHAIAAHLIAEEAVHELGAVVTGAIPGRDGAEVTLFDGTGVGLQDLAVAAKVLELAIEKGLAQQAEL

SEQ ID NO: 12 - protein, 321 aa, Rhizobium rhizogenes YR147
MIIVPENEIAGLVTPADCLKAVEGVFASMANKSAYNFPVIREAIGHADALYGFKSGFDRKGLALGLKAGGFWPNNVHKGLTNHQSTVLLFDADTGKCRAVVGGNLLTALRTAAASAISIKYLARKDAKVLGMIGAGHQATFQLRAALAQRPFEKIVGWNLHPDMLCRLEEVAKEEGLPFEAVDLDRLGAEADVIISITSSFAPMLKASQVRAGTHLACMGTDTKGKQEVEAEILAAATVFTDEVAQAITIGESQHAIERGLIREEAIVEIGAVINGTHPGRTSADQITLFDGTGVGLQDLAVASAAVELALAKGVAIEVDF

SEQ ID NO: 13 - protein, 320 aa, Roseinatronobacter thiooxidans DSM 13087
MWIVPESVIADLVDEHSAFDAIEASFAAMARGDAYNFPVVREALGAGRQYGFKSGLDRVGALLGVKAGGYFPGNADRGIPNHQSTVYLFDQDSGKPTAIVGGNLLTALRTAAASAISIAHLARKDAKVLGMVGAGHQSAFQMRAAVRQRQFDRVIGWNLHPDMLSRLAETAAELGLPFEAVDLDQLGAQADVIITITSSFDAILQDAHIRPGTHLACMGTDTKGKQELDPAILTRATVFTDEVAQSISIGEAQHAVGAGILHADAIVEIGAVINGTHHGRRDAQEITVFDGTGVGLQDLAVASRAVALAIERGLAQKIDF

SEQ ID NO: 14 - protein, 321 aa, Citreicella marina DSM 26424
MLIVPEREIADLMTRDAAFAAVEQVFAAMAADKAYNFPVVREAIGHEDALYGFKGGFDRAGLTLGLKAGGYWPNNMDKRGLINHQSTVFLFDPDTGKVRAMVGGNLLTALRTAAASSVSIRHLARKDAKVIGMIGAGHQATFQLRAALEQRGFEKVIGWNYHPEMLPNIEKVATEAGLPFAAVDLPGMAEADVIITITSAFAPSLLAEHVSPGTHIACMGTDTKGKQEVEAALLARATVFADEIAQSVSIGEAQHAIAEGLLQEADIAQLGAVINGTHPGRKDAAEITLFDGTGVGLQDLAVAAAVVDLAVAQGRAIEVDF

SEQ ID NO: 15 - protein, 324 aa, Ruegeria marina CGMCC 1.9108
MSEVLIVGEEICQQIVGRAEAFAAVEAVFAAMDRGEARNFPVVREALGHARALYGFKSGFDQAGHVLGVKSGGYWPGNMDRGLTNHQSTVFLFDPDTGQLSALVGGNYLTAVRTAASSAVSIAHLARRDARVLGMVGAGHQSTFQLRAAAEQRAFEKVVAWNPHPEMLPRLAVVAEELGLEFEAVSPQELGAQADVIISITSAFEPLLMSGWIRPGTHLACMGTDTRGKMEVDSALLARATVFTDEVAQSVSIGEAQHAVSQGLIGAEDITPIGAVINGGHPGRGSEADITLFDGTGVGLQDLAVASVAAKLAVERGLGARASL

SEQ ID NO: 16 - protein, 321 aa, Ruegeria marina CGMCC 1.9108
MLIVPERDIADLMTREAAFDAVEKVFAAMASGDAYNFPVVREAIGHEGALYGFKGGFDRADLTLGLKAGGYWPNNLEKRGLINHQSTVFLFDPDTGKPSAMVGGNLLTALRTAAASSVSIKHLARADAKVIGMIGAGHQATFQLRAALEQRTFEKVIGWNYHPEMLPNIEKVAAEAGLPFEAVDLPGMAGADVIISITSAFAPSLMADHVSPGTHLACMGTDTRGKQEVEAGLLARATVFTDEVAQSISIGEAQHAISDGLIKESDIAQLGAVINGTHPGRTSEDQITLFDGTGVGLQDLAVAAAVVDLAVDRGIAIEVDF

SEQ ID NO: 17 - protein, 326 aa, Thalassobacter sp. 16PALIMAR09
MKSHEIIIVPEAEIAGLMTPEAAFDAVEAIFGAMARKDAYNFPVIREAIGHADALYGFKSGFDRAGGALGLKSGGYWPGNEAKGLTNHQSTVILFDRDTGRPKAMVGGNLLTALRTAAASAVSIKHLARADSKVLGMIGAGHQSAFQMRAALSQRPFEKVIGWNYHPEMLSRLEAVATEAGLPFEAVDLDRLGAEADVIISITSSFDAILQDAQVTAGTHVACMGTDTKGKQEVEAALVARATVFTDEIAQSTTIGEAQHAIASGLITEAAITEIGAVINGTHPGRTSAEEVTLFDGTGVGLQDLAVAEAVVDLALKTGVATRVPF

SEQ ID NO: 18 - protein, 320 aa, Salinihabitans flavidus DSM 27842
MIIVPEREIAGLITPEAAFDAVENVFGAMARGEALNFPVIREAIGHADALYGFKSGFDRAGLVMGLKSGGYWPGNADKGLTNHQSTVILFDPDTGRATALVGGNLLTALRTAAAAAVSIRHLARPDAKVLGMIGAGHQSTFQMRAALAQRRFERVIGWNLHPERLSRLQEVAQEHDLPFEAVDLPQMREADVIITITSSFDPILMSDHVADGTHIASMGTDTKGKQELEPALVARARRFTDEVAQSVSIGECQHAVAAGLIGADDIAEIGAVINGTYPGREGAREVTLFDGTGVGLQDLAVAAAAVRLAGEKGVAIEVDF

SEQ ID NO: 19 - protein, 320 aa, Paracoccus alcaliphilus DSM 8512
MWIVPEGEIAGLMTPEAAFDAVEAVFAAMARGDASNFPVVREAIGHEDALYGFKGGFDGAGMTLGLKAGGYWPNNAKHGIINHQSTVFLFDPDTGRVSAAVGGNLLTALRTAAASAVSSKYLAPKGAKVLGMIGAGHQSAFQMKAAVRFGDFDRVIGWNPHPEMLTRLADTAAELGLPFEAVELDRLGADADVIISITSAFEPLLLDAHVTGPTHIAAMGTDTKGKQELDPVLVARSRLFTDEVAQSVSIGEFQHAAAQKLISEGDVIALGQVINGQHEGRGDAEVTIFDGTGVGLQDLAVAAAVVELAKQQGKAIEVAI

SEQ ID NO: 20 - protein, 327 aa, Paracoccus sp. PAMC 22219
MQTQSPLLIVPEHLIADLISAQDCFAAVEQVFAAMARDTAYNFPVIREAIGHADALYGFKSGFDRESLALGLKSGGFWPRNADKGLTNHQSTIFLFDADTGRCRAVVGGNLLTALRTAAASAVSIRHLARPDARVLGMIGAGHQSTFQLRAALDQRDFDKVVGWNLNPADLDRLAKVAGERGIPFQAVDLDQLGAQADVIITITSSFAPILQAAQVRPGTHLACMGTDTKGKQEVEAALLAKASVFTDEVAQSVTIGEAQHAVAQGLIAEGDITQIGAAINGDRPGRVSDDQITLFDGTGVGLQDLAVASAAVDLAVERGIAIQVQI

SEQ ID NO: 21 - protein, 321 aa, Loktanella sp. 5RATIMAR09
MIIVPEKEIAGLLTRADAFDAVEKVFASMSKGSAYNFPVIREAIGYEDALYGFKGGFDKAGMALGLKAGGYWPNNLEKHGHINHQSTVFLFDPDTGMVKAMVGGNLLTALRTAAASSVSIKHLARKDAKVMGMVGAGHQATFQLRAALEQRNFEKVIGWNYHPEMLPNIEKVANEAGVPFEAVPLEGLAEADVVISITSTFAPTIMADHIAPGTHIACMGTDTKGKQEVEASLLARATVFTDEVAQSISIGEAQHAVASGLIEQSDVHELGAVINGTHPGRTSADEITLFDGTGVGLQDLAVASSIVDLAVEKGIAIIVDF

SEQ ID NO: 22 - protein, 332 aa, Psychrobacter urativorans R310.10B
MIEENNINNEGLLIVSEDACKAVIDRDSAFTAVKNVFASMSRGDAYNFPVIREAIGYADALYGFKSGFDRAGKSLGLKSGGYWPGNAAKGLTNHQSTIFLFNPDNGKLRALVGGNYLTAVRTAAASAVSIAHLARKDSKVLGMVGAGHQSTFQLRAALEQRNFEKVIAWNKDADRLSILQEIAEELGIPFESVEREQLCAEADVIITITSAFEPLLMKEWIKPGTHIACMGTDTVGKQEVDAALIVSATVFTDEIAQSISIGEAQHAIKSGAITADAITTLGDVINGEHPGRSSDDEITLFDGTGVGLQDLAVASAAARLAVEKGQAQHISL

SEQ ID NO: 23 - protein, 321 aa, Octadecabacter temperatus SB1 null replaces 100945
MYIVPEAAIADILTRDAAFDAVENVFAAMSAGDAYNFPVIREAIGHEDALYGFKGGFDGKGMSLGLKAGGYWPHNLAERGLINHQSTVFLFDPDTGKVAAMVGGNLLTALRTAAASSVSIKHLARKDSKVMGMIGAGHQAKFQLRAALETHQFEKVIGWNRNANALSTLADVAAEFDLPFEAVSLEGMVEADVVISITSVFSPIFGAAHISDGTHVACMGTDTIGKQEADTDLVTKATVFTDEVAQSVTLGEAQHAVGAGLKSREDIHELGAVINGTHKGRTSDTEITLFDGTGVGLQDLAVSASIVEIAKAKGIGLEVDF

SEQ ID NO: 24 - protein, 321 aa, Leisingera sp. ANG-S
MYIVPEKAIADLVTREASFDAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQATFQLRAALEQRQFEKVIGWNYHPEMLPNIEKVAAEAGLPFEAVDLPGMAEADVIISITSAFAPSLMADHVSPGTHVACMGTDTKGKQEVEAELLVKASVFTDEVAQSISIGEAQHAVAQGLIQESDVAQIGAVINGTNPGRTSDDQITLFDGTGVGLQDLAVAASVVEVAVEKGIAIEVDF

SEQ ID NO: 25 - protein, 334 aa, Neptunomonas antarctica DSM 22306
MLAPVDPPTNKKGISIVSEDVCQQTVGRPEAFTAVENVFAAMARGDAYNFPVVREAIGHADALYGFKSGFDRAGMSLGVKSGGYWPGNAAKGLTNHQSTIILFDPDTGQIKSIVGGNYLTAVRTAASSAVSIAHLARKDAKVLGMIGAGHQSTFQLRAAVEQRDFEKVLAWNPHPKNLVRLATVCAELGLPFEAVEREQLCAEADVIITITSAFEPLLRHEWIKPGTHIACMGTDTKGKQEVDPALLVAATLFTDEIAQSISIGEAQHAVASGALKAGDITSLGDVINGDHCGRSSAEEITLFDGTGVGLQDLAVASVAVQLADERKLSSKISL

SEQ ID NO: 26 - protein, 321 aa, Sinorhizobium fredii CCBAU 83753
MIIVPENQIAGLMTPADCLVAVEEVFASMAKRSAYNFPVIREAIGYADALYGFKSGFDRSNLALGLKSGGFWPNNVQIGLANHQSSVFLFDADTGKCRAVVGGNLLTALRTAAASAISIKHLARKDAKVLGMIGAGHQSAFQLRAAVEQRSFEKILAWNLHPEMLSRLAEVAMELKLPFKIVDLERLGAESDVIISITSSFAPIFKASQVRPGTHLACMGTDTKGKQEMEAELVAAATVFTDEVAQAVTIGECQHAIEKKLLSRDDITELGAVITGRHPGRSSPDEITLFDGTGVALQDLAVASAAVAHAVSRGTAIEVDF

SEQ ID NO: 27 - protein, 321 aa, Defluviimonas indica DSM 24802
MLIVPEREIADLMTREAAFDAVEKVFAAMASGDAYNFPVIREAIGHEDALYGFKGGFDRAGLTLGLKAGGYWPNNLERHGLINHQSTVFLFDADTGMVKAMVGGNLLTALRTAAASSVSIKHLARRDAKVLGMVGAGHQATFQLRAALEQRAFEKVIGWNYHPEMLPRIEKVAAEAGVPFEAVELDGMREADVIISITSAYAASLMAKHVSPGCHVACMGTDTKGKQEVEAALLARATVFTDEIAQSVTIGEAQHAIAEGLIGESDIAQLGAVINGTLPGRTSQEQITLFDGTGVGLQDLAVAASVVALAVEKGAAIEVDF

SEQ ID NO: 28 - protein, 328 aa, Marinomonas sp. S3726
MSTENKGVSIVSEKTCQAVVGRPEAFTAVENVFAAMAKNSAYNFPVVREAIGHADALYGFKSGFDRDGMVLGVKAGGYWPGNAQQGITNHQSTVILFDPDTGKIKSLVGGNYLTAVRTAASSAVSIAHLARKDSKVLGMVGAGHQSTFQLRAAVEQRDFEKVVAWNFHPDMLPNLEKVCVELGLPFEAVSREELGAQADVIITITSAFESLMQKDWIKPGTHIACMGTDTKGKQEVDADLLAAATVFTDEVAQSISLGEAQHAIESGLIQISDITPIGEVINGTHQGRTSEDEITLFDGTGVGLQDLAVASAAADLAEAQGKANFIDL

SEQ ID NO: 29 - protein, 321 aa, Oceanicola flagellatus CGMCC 1.12644
MLIVPEREIANLMTRSAAFDAVESVFAAMASKNAYNFPVIREAIGHEDALYGFKGGFDKQGMTLGLKAGGYWPNNLEKHGVINHQSTIFLFDPDTGMVKAMVGGNLLTALRTAAASSVSIKHLARKDAKVMGMVGAGHQATFQLRAALEQRPFEKVIGWNYHPEMLPNIEKVANEAGVPFEAVELDGMVEADVVISITSTFEPTVMAKHISPGTHIACMGTDTKGKQEVEAALLGKATVFTDEVAQSITIGEAQHAIYNHMIRPENIVQIGEVINGTHKGRTSDDEITLFDGTGVGLQDLAVAASVVELAVKNGVAIEVDF

SEQ ID NO: 30 - protein, 321 aa, Phaeobacter inhibens S4Sm
MRIVPEAIIKDHISREDSFEAVEQVFASMAARSAYNFPVIREAIGHADALYGFKSGFDRNALNLGLKSGGYWPGNSEKGLTNHQSTVFLFDADTGKCSAIVGGNLLTALRTAAAAAVSVAHLARKDAEVLGIVGAGHQASFQLRAVAEQRDFKKVVAWNRSPEKLATLEQVARELGLPFEAVSVEDLCAQSDVIVTITSSFDAIIHSDQVRPGTHIACMGTDTKGKQEVDAALVARSSVFTDEIAQSTTIGEAQHAVAIGSLSEAAIVELGAVINGAHPGRGSADEVTLFDGTGVGLQDLAVAATVVERASKAGAAIDVDF

SEQ ID NO: 31 - protein, 321 aa, Brevirhabdus pacifica DSM 27767
MYVVPESAIADLISPQDSFEAVESVFAAMARKDAYNFPVIREAIGHADALYGFKSGFDRAGLVLGLKAGGYWPGNADKGLTNHQSSVFLFDPDTGRPTAMVGGNLLTALRTAAASAVSIRYLAPKGAKVLGMIGAGHQSAFQMRAAAKQRDFEKVIGWNFHPEMLSRLEETAAELGLPYESVDLDRMGAEADVIVSITSSFDPILKDAQVKGGTHLACMGTDTKGKQEVEAALLARARVFTDEIAQSITIGEAQHAVADGSLAESDITEIGAVIAGMDPGRRSDDEITLFDGTGVGLQDLAVAAKAVELARERGIGQEIEV

SEQ ID NO: 32 - protein, 321 aa, Methylobacterium radiotolerans SB3
MIIVPEHAIDGLLTEAECFGAVEQVFASMARRRAGNFPVVREAIGHADALYGFKSGFDRDSLALGLKAGGFWPGNAAKGLTNHQSTVFLFDADTGRCRAVVGGNLLTALRTAAACAISIRHLAREGARVLGMIGAGHQSAFQLRAALVQRPFERVLAWNLHPGMFGRMEAVARERGVPFEVVDLDRLGAEADVVVTITSSFAPILKAAQVRPGTHVACMGTDTRGKQEVEAELLAAATVFTDEVAQSVSLGEAQHAVARGLLAADSIVEIGAVINGDHPGRVSDAEITVFDGTGVGLQDLAVAAVAVDRALAKGLATEVGF

SEQ ID NO: 33 - protein, 321 aa, Pelagimonas varians DSM 23678
MLIVPERDIADLMTRDAAFDAVERVFAAMAAGDAYNFPVVREAIGHEEALYGFKGGFDQSGLTLGLKAGGYWPNNLEKRGIINHQSTIFLFDPDTGKVKAMIGGNLLTALRTAAASSVSIKHLARPDAKVIGMIGAGHQATFQLRAALEQRNFEKVIGWNYHPDMLPNIEKIATEAGVPFEAVELEGMRQADVIISITSAFAPSLMADHVAPGTHVACMGTDTKGKQEVEAALLAKAAVFTDEVAQSITIGEAQHAVAQGLIAEADVAQLGAVINGTDAGRTSEDQITLFDGTGVGLQDLAVAAAVVDLAVEQGIAIEVDF

SEQ ID NO: 34 - protein, 321 aa, Thalassobius mediterraneus 5120
MHIVPERDIADLMTRAAAFDAVEKVFAAMAAEDAYNFPVIREALGHEEALYGFKGGFDRAGSTLGLKAGGYWPHNLEKRGLINHQSTVFLFDPDTGKVSAMVGGNLLTALRTAAASSVSIKHLAREDAKVIGMVGAGHQATFQLRAALEQRSFEKVIGWNLHPEMLPNLEKVAAEAGLPFEAVDLPGLKEADVVITITSSFDPIVLSEHISDGTHVACMGTDTIGKQEVAADLLTRATVFTDEVAQSTTLGEAQHAVANGSLTADQITQLGAVINGTHGGRASDREVTLFDGTGVGLQDLAVAARVVELAIEKGTAIEVDF

SEQ ID NO: 35 - protein, 321 aa, Jannaschia sp. CCS1
MYIVPERAIADLMTREAAFDAVEKVFAAMAAGDAYNFPVVREAIGHEDALYGFKGGFDQAGLTLGLKAGGYWPNNLEKRDLINHQSTVFLFDPDTGKAKAMVGGNLLTALRTAAASSVSIKHLARDDAKVIGMIGAGHQATFQLRAALEQRTFEKVIGWNYHPDMLPNIEKVATEAGVPFEAVDLPGMAEADVIISITSAFAPSLMADHVAPGTHIACMGTDTKGKQEVEAALLARATVFTDEVAQSVSIGEAQHAVADGLIAEGDVHQLGAVINGTHAGRASADEITLFDGTGVGLQDLAVAASVVDLAIKKGVAIEVDF

SEQ ID NO: 36 - protein, 321 aa, Mesorhizobium sp. BNC1
MIIVPEREISGLISAADCFTAVEQVFASMARKSATNFPVIREAIGHAGALYGFKSGFDRESLALGLKSGGFWPNNVEKGLTNHQSTIFLFDADTGRCRAVVGGNLLTALRTAAASAVSIKYLARRDAQVIGIVGAGHQSTFQLRAALDQRAFKKVVGWNIDPEMLSRLQVVAAERNIPFESVDLDRLGAEADVIITITSSFASLLKAAQVRPGTHLACMGTDTKGKQEVEAELVAMATVFTDEVAQSISIGEAQHAVEKGLLAAGDIIELGQVINGMHPGRSSDDEITLFDGTGVGLQDLAVASAAVDLAIARGVALEVDF

SEQ ID NO: 37 - protein, 321 aa, Mesorhizobium sp. BNC1 plasmid 1
MIIVPERLISDLMSEAAVFEAIESVFAAMARDEARNFPVIREAIGYADALYGFKAGFDSAGLVLGVKAGGYWPGNMAKGLTNHQSTVLLFDPDTGRIKAAVGGNLLTALRTAAASAVSIKHLARPDARVLGMVGAGHQSAFQMRAAVRARKFDKVVGWNLHPEMLSRLADTAVELGLPFEVVDLPQLGAQADVIITITSSFAPILLSGHIRPGTHLACMGTDTKGKQEVEAALFPRARLFADEVEQSVTIGEAQHAVAQGLIATGDITPLGAVIAGLAPGRTSPEEITLFDGTGVGLQDLAVASVAVDIARARGLALEVEL

SEQ ID NO: 38 - protein, 333 aa, Roseovarius sp. TM1035
MNTHKEVAADGFVIVGEEICQKIISRADAFGAVEAVFAAMARGDAYNFPVVREAIGHADALYGFKGGFDRSGLSLGLKAGGYWPGNMDKGLTNHQSTVFLFDPDTGRLSALVGGNYLTAIRTAASSSVSIAHLARKDAKVLGMVGAGHQSAFQLRAAVEQRAFEKVVAWNPHPDMLPRLGAVAKELGLEFEAVTQEELGAQADVIITITSAFEPLMMADWVKPGTHIACMGTDTKGKQEVDPALFTRATVFADEIAQSITIGEAQHAVGKGLIAEGDITPIGAVINGTHGGRSNAEEITLFDGTGVGLQDLAVASVAAKLAREQGLVTPITLG

SEQ ID NO: 39 - protein, 321 aa, Methylobacterium radiotolerans JCM 2831 plasmid pMRAD01
MIIVPEHAIDGLLTEAECFGAVEQVFASMARRRAGNFPVVREAIGHADALYGFKSGFDRDSLALGLKAGGFWPGNAAKGLTNHQSTVFLFDADTGRCRAVVGGNLLTALRTAAACAISIRHLAREGARVLGMIGAGHQSAFQLRAALAQRPFERVLAWNLHPGMFGRMEAVARERGVPFEVVDLDRLGAEADVVVTITSSFAPILKAAQVRPGTHVACMGTDTRGKQEVEAELLAAATVFTDEVAQSVSLGEAQHAVARGLLAADSIVEIGAVINGDHPGRVSDAEITVFDGTGVGLQDLAVAAVAVDRAVAKGLATEVDF

SEQ ID NO: 40 - protein, 347 aa, Rhizobium sp. NGR234 plasmid pNGR234b
MACLGSGQGVLTKEGHRPSCNQSEGKMIIVPESQIPALVTSADCFVAVEDVFASMSKQSAYNFPVIREAIGHADALYGFKSGFDRESLALGLKSGGFWPNNIHKGLANHQSTVFLFDADTGKCRAIVGGNLLTALRTAAASAVSIKYLARQDAKVLGMIGAGHQSTYQLRAAVEQRPFEKVLAWNFHPEMLSRLEDVAKELELPFETVDLDRLGAEADVIISITSSFAPILKASQVRPGTHLACMGTDTKGKQEMDADLVAGATVFADEVAQAVTIGECQHAFEKGLITRDDIIELGAVITGRHPGRSSPEEITLFDGTGVALQDLAVASAAVELALSRGTAIEVDF

SEQ ID NO: 41 - protein, 321 aa, Citreicella sp. SE45 genomic scaffold scf_1113211290443
MLIVPEREIADLMTREAAFSAVEQVFAAMAAGNAYNFPVVREAIGHEDALYGFKGGFDRAGLTLGLKAGGYWPHNLEKRGMINHQSTVFLFDPDTGKAKAMVGGNLLTALRTAAASSVSIRHLAREDAKVIGMVGAGHQATFQLRAALEQRDFDKVIGWNLHPEMLPNLEKVAAEAGLPFEAVELEGMRAADVIISITSSFDAILMEEHVAPGTHIACMGTDTKGKQEVAPALLAKATVFTDEVSQSVSIGEAQHAVAQGLIRETDISQLGAVINGAHPGRRSAEEITLFDGTGVGLQDLAVAAAVVDLAVEKGIAIEVDF

SEQ ID NO: 42 - protein, 321 aa, Citreicella sp. SE45 genomic scaffold scf_1113211290440
MLIVPEREIGALMTRASAFEAVEKVFAAMASGEAYNFPVIREAIGHEDALYGFKGGFDRAGLTLGLKAGGYWPNNLEKFKVINHQSTVFLFYPDTGKVAAMVGGNLLTALRTAAASSVSIAHLARRDAKVMGMVGAGHQATFQLRAALEQRPFEKVIGWNLHPEMLPNIETVADEAGLPFEAVPLEGMREADVIVSITSSFAPSLMAAHVSPGTHLACMGTDTRGKQEVEAALLAVATVFTDEVAQSVSIGEAQHAVAEGLISESDVHQIGAVINGSHPGRRSDEEITLFDGTGVGLQDLAVAAAVVDLAVEKGIAIEVDV

SEQ ID NO: 43 - protein, 321 aa, pCaer_C109
MYIVPEKAIADLVTREASFDAVEKVFAAMAAGDACNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQAKFQLRAALEQREFEKVIGWNLHPEMLPNLQEVADEAGLPFEAVELDGMREADVIISITSSFDAILKADQVSPGTHIACMGTDTKGKQEVDPQLLVKADVFTDEVAQSISIGEAQHAVTQGLIQEADVAQIGAVINGTNPGRTSDDQITLFDGTGVGLQDLAVAASVVDVAVEKGVAIEVDF

SEQ ID NO: 44 - protein, 293 aa, Ensifer fredii USDA257
MAKRSAYNFPVIREAIGHADALYGFKSGFDRDSLALGLKSGGFWPNNVQNGLANHQSTVFLFDADTGRCRAVVGGNLVTALRTAAASAVSIKYLARKNAKVLGMIGAGHQSTYQLRAAVEQRPFEKVLAWNLHPEMLSRLEGVARELELPFETVDLDRLGDEADVIISITSSFAPILKASQVRPGTHLACMGTDTKGKQEMDAELIAAATVFTDEVAQAVTIGECQHAIEKGLISKDDIVEIGAVITGRHKGRSSPEEITMFDGTGVALQDLAVASAAVAHAVSRGTAIEVDF

SEQ ID NO: 45 - protein, 320 aa, Paracoccus pantotrophus J46 ICCP
MLVVAEKEIAGLMTPEAAFEAIEAVFASMARRKAYNFPVVREAIGHEDALYGFKGGFDAAALTLGLKAGGYWPNNQKHGLINHQSTVFLFDPDTGRVSAAVGGNLLTALRTAAASAVSIKHLAPKGAKVLGMIGAGHQSAFQMRAAANVHRFEKVIGWNPHPEMLSRLADTAAELGLPFEAVELDRLGAEADVIISITSSFSPLLLNEHVKGPTHIAAMGTDTKGKQELDPALVARARVFTDEVAQSVSIGECQHAIASGLIREDQIGELGAVVAGDDPGRGDAEVTIFDGTGVGLQDLAVAQKVLEIAKQEGLAQEVEI

SEQ ID NO: 46 - protein, 320 aa, Paracoccus sp. J4
MLVVAEKEIAGLMTPEAAFEAIEAVFASMARRKAYNFPVVREAIGHEDALYGFKGGFDASALTLGLKAGGYWPNNQKHNLINHQSTVFLFDPDTGRVSAAVGGNLLTALRTAAASAVSIKYLAPKGAKVLGMIGAGHQSAFQMRAAANVHRFEKVIGWNPHPEMLSRLADTAAELGLPFEAVELDRLGTEADVIISITSSFSPLLMDQHVKGPTHVAAMGTDTKGKQELDPALVARARVFTDEVAQSVSIGECQHAIASGLIREDQIGEIGAVVAGDNPGRGDAEVTIFDGTGVGLQDLAVAKAVVELAKHKGVAQEVEI

SEQ ID NO: 47 - protein, 327 aa, Solemya velum gill symbiont (Draft Solemya velum gill symbiont genome)
MEAEKGVVVVSEATCEEVIDRASSFTAVESVFAAMARGDAYNFPVVREAIGHADALYGFKSGFDRAGMSLGVKSGGYWPGNVNLGIPNHQSTVFLFDPDTGRLKAMVGGNYLTAVRTAASSAVSINHLARKDAKVLGMVGAGHQSKFQLRAAADQRDFEKVVAWNPHPEMLPGLKAVADELGLPFESVEREELCAQADVIITITSAFEALLMKEWIKPGTHIACMGTDTKGKQEVDTALVESATLFTDEIVQSITIGENQHAIESGAISESDITPIGDVINGKHPGRSHADEITLFDGAGVGLQDLAVASVAVDLALEKDQAQHVSL

SEQ ID NO: 48 - protein, 320 aa, Paracoccus sp. N5
MFVVAEKEIAGLMTPEAAFEAIEAVFASMARRKAYNFPVVREAIGHEDALYGFKGGFDASALVLGLKAGGYWPNNQKHNLINHQSTVFLFDPDTGRVSAAIGGNLLTALRTAAASAVSIKYLAPKGAKVLGMIGAGHQSAFQMRAAAAVHGFEKVIGWNPHPEMLTRLADTAADLGLPFEAVELDRLGAEADVIISITSSFSPLLMDQHVKGPTHIAAMGTDTKGKQELDPALVARARVFTDEVAQSVTIGECQHAIAAGLIAEEAIGELGAVVSGDDPGRDGAEVTIFDGTGVGLQDLAVAQKVLEIAKEKGLAQEVEI

SEQ ID NO: 49 - protein, 334 aa, Roseovarius mucosus DSM 17069
MMNTQQQVAADGFVIVGEEICQKIISRADAFGAVEAVFAAMASGDAYNFPVVREAIGHADALYGFKGGFDRSGLSLGLKAGGYWPGNMDKGLTNHQSTVFLFDPDTGRLSALVGGNYLTAIRTAASSSVSIAHLARKDSKVLGMVGAGHQSTFQLRAAVEQRAFEKVVAWNPHPDMLPRLGAVAKELGLEFEAVTQEELGAQADVIITITSAFEPLMMADWIKPGTHIACMGTDTKGKQEVDPALFTRATVFADEIAQSITIGEAQHAVAKGLIAEGDITPIGAVINGTHGGRASEAEITLFDGTGVGLQDLAVASVAAKLAREQGLVTPITLG

SEQ ID NO: 50 - protein, 334 aa, Marinobacter sp. BSs20148
MDTSSEALTQPHQILIVSEDACQKVIGRHEAFQAVESVFSSMAKGSAYNFPVVREAIGHANALYGFKSGFDSEGLVLGVKAGGYWPGNVVQGRTNHQSIVALFDPDTGQLKALIGGNYLTAIRTAASSAVSIAHLARKNAKVLGMIGAGFQSTFQLHAALEQRDFEKVVAWNTHPEHLTRLADVCREHGLPFEAVSLQTLGAQSDVIITITSASEPLLQAAWIKPGTHLACMGTDTKGKQEVDQQLLARASVFTDEIAQSISIGEAQHAVAAKILFAEQITPIGEVINGSHQGRQSEQEITLFDGTGVGLQDLAVASAAASLAEVRGLAQRVTL

SEQ ID NO: 51 - protein, 321 aa, Ensifer sp. USDA 6670
MIIVPENQIAELITPADCLVAVEGVFASMAKRSAYNFPVIREAIGHADALYGFKSGFDRESLALGLKSGGFWPNNVREGLANHQSTVFLFDADTGRCRAIVGGNLLTALRTAAASAVSIKYLARKDAKVLGMIGAGHQSTYQLRAAVEQRPFEKVLAWNLHPEMLSRLEGVARELELPFETVDLDRLGAEADVIISITSSFAPILEASQVRPGTHLACMGTDTKGKQEMDAELLAAATVFTDEVAQAVTIGECQHAIEKGLISRDNIVEIGAVITGCHTGRSSPEEITLFDGTGVGLQDLAVASAAVELALSKGTAIEVDF

SEQ ID NO: 52 - protein, 321 aa, Rhizobium etli CNPAF512
MIIVPESAIGELISLEDCVDAVEKVFVSMAERSAHNFPVVREAIGYADALFGFKSGFDREGLALGLKAGGFWPNNADKGLTNHQSTVFLFDPETGRCRAVVGGNLLTALRTAAASAVSIKHLARRDAKVLGMVGAGHQASFQLRAAVQQRQFEKVVAWNYHPEMLPKLAAVAEELAVPFEAVDLDRLGDEADVIITITSSFQPILKASQIRPGTHLACMGTDTKGKQEVDPALVAAATLFTDEIAQAISIGECQHAVAQGMIAPIDIAEIGAVINGQKSGRTSLEEVTLFDGTGVGLQDLAVAQAAVELALARGIAVEVDF

SEQ ID NO: 53 - protein, 321 aa, Sulfitobacter sp. 20_GPM-1509m
MLIVPEREIANLMTRAAAFDAVEQVFAAMAAGDAYNFPVVREAIGHEDALYGFKGGFDRAGLTLGLKAGGYWPNNLEKRDLINHQSTVFLFDPDTGKARAMVGGNLLTALRTAAASSVSIKHLARKDARVIGMVGAGHQATFQLRAALEQRDFDKVIGWNYHPEMLPNIEKIAREAGVPFQAVDLPGMVEADVIISITSAFSPSLMADHVAPGCHLACMGTDTKGKQEVEAALLARATVFTDEVAQSVSIGEAQHAVAEGLIAESDVHQLGAVINGTHAGRVSDDQITLFDGTGVGLQDLAVAAAVVDLAVAQGIAIEVDF

SEQ ID NO: 54 - protein, 321 aa, Maribius sp. MOLA 401
MLIVPEREIPDLLTRGASFDAVEKVFAAMAAGDAYNFPVVREAIDHEDALYGFKGGFDAKGQVLGLKAGGFWPNNMERRQIINHQSTVFLFDPDTGRVAAMVGGNYLTALRTAAASSVSIRHLARGDAKVLGMIGAGHQASFQLRAALEQREFERVIAWNYHPEMLPNLAKICDEVGVPFQAVELDGMREADVIVSITSAFAPSLMADHVAPGTHVACMGTDTKGKQEVEAQLLARATVFADEVAQSVSIGEAQHAIAEGLIDKAGIHQIGAVINGTHPGRRSDGEITLFDGTGVGLQDLAVAAAIVDLAKAKGVAIEVEF

SEQ ID NO: 55 - protein, 342 aa, Amphritea atlantica DSM 18887
MGGSIEERSFEELSPVDAGAGISLVSEAVCEQVVGRPEAFTAVESVFAAMASGAAYNFPVVREAIGHADALYGFKSGFDRAGMVLGVKSGGYWPGNVDKNLTNHQSTVILFDPDTGQLRSLVGGNYLTAVRTAAASAVSIAHLARKDARVLGMVGAGHQSTFQLRAALEQRNFEKVVAWNPHPEYLSRLAAVCEELGMPFAAVEREQLGAEADVIITITSAFEPLLMKQWIKPGTHIACMGTDTKGKQEVDPELLASASVFTDEVAQSISIGEAQHAVASGLLNEADITPIGEVINGTHPGRRDDLEITLFDGTGVGLQDLAVASAAVELAQAKGLAGQVSL

SEQ ID NO: 56 - protein, 320 aa, Rhodobacteraceae sp. HL-91
MWIVPESAIGGLVDDQSAFDAVEATFAAMARDDAYNFPVVREALGEGRQYGFKSGLDRAGAQLGVKAGGYFPGNAAKGIINHQSTVFLFDPDTGILQAAVGGNLLTALRTAAASAISIAHLSRADSTVLGMVGAGHQSVFQMRAALRQRKFERVVAWNYHPDMMDRLASAVAEEGLPFEEVSLEELGAQADVIITITSSPAASLMDAHVRPGTHIACMGTDTIGKQEVDPALLARAAVFTDEVAQSVTIGEAQHAIAQGLIKPEDITPIGAVINGAHKGRTSAEEITLFDGTGVGLQDIAVASKAVDLARANGSAIEVAL

SEQ ID NO: 57 - protein, 321 aa, Methylobacterium sp. UNCCL143
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFERVLAWNLHPGMFGRMEAVAREHGVPFEAVDLDRLGSEADVVVTITSSFAPILKAVQVRPGTHLACMGTDTRGKQEVEAELLAAATVFTDEVAQSVSIGEAQHAVARGLLAADSIVEIGAVINGDHPGRVSESEITLFDGTGVGLQDLAVAAVAVDRAVAKGLATEVEV

SEQ ID NO: 58 - protein, 321 aa, Aquisalimonas asiatica CGMCC 1.6291
MQIVSEKAVKAAVSRADAFTAVESVFAAMATGQAWNFPVVREAIGHADALYGFKSGFDRDHMALGVKSGGYWPGNAARGLTNHQSTVLLFDPDTGQPRALVGGNYLTAVRTAAASAVSIQHLARPDAKTLGIVGAGHQAPFQLRAAVEQRPIERVVAWNRSPERLESLREAAQAMGLPFEAVDRDTLCEQADVIITITSCFEPLLTREQIRPGTHIACMGTDTAGKQEIDPAILASAEVFTDDPTQAATIGECQHAVAQGHIHRDAIRPVGGVIGEPGSFRRSAEAITVFDGTGVGLQDLAVARVALERAVEAGTAVRIDL

SEQ ID NO: 59 - protein, 330 aa, Thalassotalea sp. ND16A
MSDQHNNQGVVVVTEEVCQAIMGRSDAFTAVENVFAAMSKNTAYNFPVIREAIGHADALYGFKSGFDRDSMVLGLKSGGYWPGNVEKGLTNHQSTVILFDPDTGKLKSLVGGNYLTAVRTAASSAVSIAHLARQDSKVLGMIGAGHQSTFQLRAAVEQRNFEKVVGWNIDPERLSILAEVCAELSLPFESVSREELCALSDVIITITSAFEALLDNAWIKPGTHIACMGTDTKGKQEVDAKLFRTATVFTDELAQSITIGEAQHAIQSGLIVESDIVPIGEVINGTNSGRTSEDEITLFDGTGVGLQDLAVASVAAELAQAKGQAFYINL

SEQ ID NO: 60 - protein, 329 aa, Roseovarius lutimaris DSM 28463
MSANTDDGLLIVSEEICEQVIRRPDAFSAVEAVFGAMARGDAYNFPVVREAIGHADALYGFKSGFDRAGMVLGVKAGGYWPGNMAKGLTNHQSTVCLFDPDTGRLVALVGGNYLTALRTAASSAVSIAHLARKDAKVLGMVGAGHQSTFQLRAAVEQRDFERVVAWNPHPDMLPRLAAVAEELGLAFEAVTPEGLGAQADVIITITSAFEPLIMADWIKPGTHIACMGTDTKGKQEVDPALFKSATVFADEIAQSITIGEAQHAVASGLIGEGDLTAIGEVINATHPGRSSDDEITLFDGTGVGLQDLAVASVAARLAREQGLVTPVAL

SEQ ID NO: 61 - protein, 322 aa, Halocynthiibacter sp. PAMC 20958
MIIVPEREIADLMTREVAFNAVEGVFAAMAAQDAYNFPVVREAIGYEDALYGFKGGFDKAGMTLGLKAGGYWPHNLDKHQLINHQSTIFLFDPDTGRVTAMVGGNLLTALRTAAASSVSIKHLARKDSKVIGMIGAGHQATFQLRAALEQREFEKVIGWNYHPEMLPNLEKVANEAGLPFEAVELDQLGHDADVIISITSAFAPSLLAKHVSAGTHIACMGTDTKGKQEVESALLARATVFTDEVAQSISIGEAQHAVAEGLIKESDVNQIGAVINGTHPGRVAADEITLFDGTGVGLQDLAVAASVVALAVKKGVAIDVDF

SEQ ID NO: 62 - protein, 321 aa, Leisingera sp. ANG-S3; identical to SEQ ID NO: 24

SEQ ID NO: 63 - protein, 320 aa, Paracoccus saliphilus DSM 18447
MWVVPEKEIAGLMTPEAAFDAVEAVFAAMASGEANNFPVVREAIGHEDALYGFKGGFDKSALNLGLKAGGYWPNNQKRDLINHQSTVFLFDPDTGRVSAAVGGNLLTALRTAAASAVSIKHLAPEGAKVLGMIGAGHQSAFQMKAAARVGNFERVIGWNPHPEMLTRLADTAAELGLPFEAVELPRLGAEADVIISITSAFEPLLMDAHVKGRTHIAAMGTDTKGKQELDPALVARARLFTDEIAQSLSIGEFQHASAAGSISDGDVTAIGQVITGNHEGRGDAEITIFDGTGVGLQDLAVAGAVVDLARQQGKAVEVEI

SEQ ID NO: 64 - protein, 321 aa, Rhodovulum sulfidophilum DSM 1374
MFIVPEKEIAGLVSADQCFEAVEAVFAAMARGDAYNFPVIREAIGHAEALYGFKSGFDRAGAVLGLKSGGYWPGNAAKGLTNHQSTVVLFDPDSGRPAALVGGNLLTALRTAAASAVSIRYLARSDARVLGVLGAGHQSAFQLRAAVAQRRFEKIVGWNYHPEMLPRLAETAAELGLPFEAVSLEDFGAQADVIVTISSSFSAQLMDAHVRPGTHLACMGTDTTGKQEIDPAIFVRARVFADEIAQSVEIGEAQHAVAAGLIAAEDIVEIGAVINGTAPGRQSDDEITVFDGTGVGLQDLAVAARAVAAARARGVAVEVDL

SEQ ID NO: 65 - protein, 321 aa, Litoreibacter ascidiaceicola DSM 100566
MFIVPEREIADLMTRDAAFDAVESVFAAMASKDAYNFPVIREAIGHEDALYGFKGGFDKAGMTLGLKAGGYWPNNLEKHGHINHQSTIFLFNPDTGMVSAMVGGNLLTALRTAAASSVSIKHLARKDAKVMGMVGAGHQATFQLRAALEQRQFEKVIGWNYHPEMLPNIEKIAIEAGLPFEAVELDGMREADVVISITSTFAPTIMADHIAPGTHIACMGTDTKGKQEVEAALLARATVFTDEVAQSVSIGEAQHAVAQGLIKESDVHQLGAVINGTHKGRTSDDEITLFDGTGVGLQDLAVAASVVELAVAKGVAIEVDF

SEQ ID NO: 66 - protein, 329 aa, Roseovarius marisflavi DSM 29327
MSANTDDGLLIVSEEICEKVIRRPDAFSAVEAVFGAMARGDAYNFPVVREAIGHADALYGFKSGFDRAGMVLGVKAGGYWPGNMAKGLTNHQSTVCLFDPDTGRLTALVGGNYLTALRTAASSAVSIAHLARKDAKVLGMVGAGHQSTFQLRAAVEQRDFERVVAWNPHPDMLPRLAAVAEELGLAFEAVTPEELGAQADVIITITSAFEPLIMADWIKPGTHIACMGTDTKGKQEVDPALFKSATVFADEIAQSITIGEAQHAVASGLIGEGNLTAIGEVINGTHPGRSSAEEITLFDGTGVGLQDLAVASVAARLAREQGLVTPVAL

SEQ ID NO: 67 - protein, 321 aa, Rhodovulum sp. ES.010
MIIVPEKEIAGLVSAEDSFSAVEAVFAAMARGDAYNFPVIREAIGHADALYGFKSGFDRAGLVLGLKSGGYWPGNAEKGLTNHQSTVVLFDADTGQAHALVGGNLLTALRTAAASAVSIKHLARDDAKVLGMVGAGHQSAFQMRAAAAQRDFERVVGWNYHPEMLPRLAETAEELGLPFEAVSLEELGAQADVIVTITSSFEAQLKDTHVRPGTHLACMGTDTKGKQEVDPAILARARVFTDEVAQSITLGEAQHAVAAGLIGEGDITQIGAVIEGTAAGRQSAEEITLFDGTGVGLQDLAVAAKAVDLAQEKGAAIDVAF

SEQ ID NO: 68 - protein, 321 aa, Ruegeria sp. P4
MYIVPERAIADLMTRDAAFDAVEKVFAAMAAGDAYNFPVVREAIGHEDALYGFKGGFDRAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLPNLEEVATEAGLPFEAVELDGLKEADVIISITSSFDAILQADQVSPGTHIACMGTDTKGKQEVDPQLLVRATVFTDEVAQSTSIGEAQHAVAQGLIAEADVAQLGAVINGAHPGRSSAEQITLFDGTGVGLQDLAVAASVVELAVKKGIAIEVDF

SEQ ID NO: 69 - protein, 321 aa, Jannaschia rubra CECT 5088
MIIVPEAVIADLITPEASFTAVERVFASMAARSAYNFPVIREAIGHADALYGFKSGFDRAALNLGLKSGGYWPGNAAKGLTNHQSTVFLFDADTGKCRAVVGGNLLTALRTAAAAAVSVAHLARPDAKVLGIVGAGHQAAFQLRAVAAQRPFEKIVAWNRSPEKLETLRGVADELGLGFESVSIEDLGGQADVIVTITSSHDAILHGAQVKPGTHVACMGTDTKGKREVDNDLIAAATLFTDEVAQSTTIGECQHAIVDLTIRPEDITELGAVINGDHKGRTSAEEITLFDGTGVGLQDLAVASAVVELAMSRGVATEVDF

SEQ ID NO: 70 - protein, 327 aa, Ruegeria atlantica CECT 4292
MTTQEGLLIVGEDLCEQLVGRQQAFDAVQSVFGAMANGGARNFPVVREALGYADALYGFKSGFDRDGQVLGVKSGGYWPGNAEQGLTNHQSTVFLFDPDTGRLSALVGGNYLTAVRTAASSAVSIAHLSRKDAKVLGMVGAGHQSAFQLRAAAEQRGFEKVVAWNPHPDMLPRLAAVAEEIGLEFEAVSQQELGAQSDVIITITSAFEPLLMKDWIKPGTHLACMGTDTKGKMEVDPALVASATVFTDEVAQSATIGEAQHAMGSGTLTETQITPIGAVINGDHPGRSSVDEITLFDGTGVGLQDLAVASVAARLADEAGLAQRATL

SEQ ID NO: 71 - protein, 321 aa, Rhizobium sp. N324
MIIVPERAIADLIGSAECFTAVEQVFAAMARKSAYNFPVVRESIGYADALYGFKSGFDRESLSLGLKSGGFWPKNAEKGLTNHQSTVFLFDADTGRCRAVVGGNLLTALRTAAASAISIKYLAREDAKILGIIGAGHQSTFQLRAAVQQRNFEKVVAWNYHPEMLTRLEDVAKEVGLPFEAVDLHRLGAEADVIISITSSFRPSLMASQVRPGTHLACMGTDTKGKQEVDAKLVAASSLFTDEVAQAITIGECQHAIAAGLIAAEDILEIGAVITGEEKGRRSADDITLFDGTGVGLQDLAVASAVVDLAVSKGVAIEVDF

SEQ ID NO: 72 - protein, 321 aa, Rhizobium sp. N941; identical to SEQ ID NO: 71

SEQ ID NO: 73 - protein, 321 aa, Sinorhizobium americanum CFNEI 73
MIIVPENQIAGLITPADCLVAVEGVFASMAKKSAYNFPVIREAIGHADALYGFKSGFDRDSLALGLKSGGFWPNNVEKGLANHQSTVFLFDADNGRCRAVVGGNLLTALRTAAASAVSIKYLARKDAKVLGMIGAGHQSTYQLRAAVEQRPFEKVLAWNLHPEMLSRLEEVARELELPFETVDLDRLGAEADVIISITSSFAPILKASQVRPGTHLACMGTDTKGKQEMDPELIAAATVFTDEVAQAVTIGECQHAIDKGLISKGDIVEIGAVITGRHKGRSSPEEITLFDGTGVGLQDLAVASAAVELALSKGTAIEVDF

SEQ ID NO: 74 - protein, 321 aa, Puniceibacterium sediminis DSM 29052
MLIVPESKIADLMTPEAAFDAVEATFAAMARKSAYNFPVIREAIGHADALYGFKSGFDRESLVLGLKSGGYWPGNAEKGLTNHQSTIFLFDADTGKCSAIVGGNLLTALRTAAASAVSIKHLARQDSEVLGMIGAGHQSVFQMQAAVKQRNFKKVIGWNYHPEMLSRLADCAAELGLPFEEVSLETLGRDADVIISITSSFAPTLLDAHVTPGTHIACMGTDTKGKQEVEATLLKRATVFTDEIAQSISIGEAQHAVAAGLIAQSDITEIGAVINGTHPGRSSADEITLFDGTGVGLQDLAVAAKVVELAQQKGVALDVDF

SEQ ID NO: 75 - protein, 321 aa, Hyphomicrobium sulfonivorans WDL6
MIIIPEREIAGLISAADCFVAVERVFASMARRSAYNFPVVRESIGHASALYGFKSGFDRENLSLGLKAGGFWPDNAEKGLTNHQSTVFLFDADTGRCRAIVGGNMLTALRTAAASAVSIKYLARADAKVLGMIGAGHQSTFQLEAALDQKLFEKVLGWNIEPNALSRLEAVALKRNIPFERVSLDRLGAEADVIITITSSFAPILKTVQVRPGTHLACMGTDTKGKQEVEASLVAAATVFTDEIGQSIAIGEAQHAINEGLMEADEIVEFGNVVCGNHRGRTSADEITLYDGTGVGLQDLAVASAVVELAITRGVATEMDL

SEQ ID NO: 76 - protein, 321 aa, Marivita geojedonensis DSM 29432
MYIVPEAMIADLVSREASFEAVEQVFAAMAAKDAYNFPVVREAIGHEDALYGFKGGFDRVGGALGLKAGGYWPHNLEKRGLINHQSTVFLFDPDTGKVRAMVGGNLLTALRTAAASSVSIKHLARADARVMGMVGAGHQATFQLRAALEQRPFEKVIGWNYHPEMLPNIEKVANEAGVPFEAVDLPGMAEADVIISITSAFAPSLMADHVSPGTHLACMGTDTKGKQEVESALLARAKVFTDEVAQSVSIGEAQHAVAAGLIAESDVTEIGAVINGTHPGRTSGDDITLFDGTGVGLQDLAVASKVVDLAIERGVAIEVDF

SEQ ID NO: 77 - protein, 332 aa, Marinobacterium mangrovicola DSM 27697
MTTPASGAGNPVSIVSEAVCQQIVGRPEAFKAVENVFAAMARGDAYNFPVVREAIGHADALYGFKSGFDRAGMALGVKSGGYWPGNVQKDLTNHQSTVILFDPDTGQLKSLVGGNYLTAVRTAAASAVSIAHLARRDAKVLGMVGAGHQSTFQLRAALEQRDFEKVVAWNPHPEHLPRLAAVCEELRVPFEAVTQQELGAQADVIITITSAFEPLLLKEWIKPGTHIACMGTDTKGKQEVDPALLAAASVFTDEVAQSISIGEAQHAVASGLIAEADITPIGKVINGTHVGRRDDQEITLFDGTGVGLQDLAVASAAAELAEQQGLSQKIIL

SEQ ID NO: 78 - protein, 321 aa, Stappia aggregata IAM 12614
MIIVPEKEIAGLIGRQESFDAVESVFAAMASGAACNFPVIREAIGHADALYGFKSGFDRSSLALGLKSGGYWPGNMAKGLTNHQSTVFLFDADTGKAKAVVGGNLLTALRTAAASAVSIKHLARKDAKVLGMIGAGHQSAFQMRAAAEQRSFEKVLGWNLHPEMLVRLEATANELGLPYESVDLARLGAEADVIISITSSFDPILMEEHVTPGTHIACMGTDTKGKQEVDTALVAKAKLFTDEVAQSATIGECQHAVASGIVSEDNIIEIGAVINGNHPGRISQSDITLFDGTGVGLQDLAVASAAVDLAIQKGVAIEVDF

SEQ ID NO: 79 - protein, 331 aa, Sagittula stellata E-37
MKDTPQQGDGVLIVGEEACRALVGRAEAFAAVEAVFAAMASGEARNFPVVREAIGHADALYGFKSGFDRAGMALGVKAGGYWPGNAGRGLTNHQSTVCLFDPDTGRLSALVGGNYLTAVRTAASSAVSIAHLARRDAKVLGMVGAGHQSAFQLRAAAEQRAFEKVVAWNPHPEMLPQLAEVAASLGLPFEAVTPEELGAQADVVITITSAFEPLLMRDWIRPGTHVACMGTDTKGKMEVDAALLAAATVFTDEVAQSVSLGEAQHAVAGGLLSEGDITPIGAVINGTHPGRTSDDEITLFDGTGVGLQDLAVASVAARLAEAQGVAARVVL

SEQ ID NO: 80 - protein, 321 aa, Roseobacter sp. CCS2
MIIVPEKEMAGLLNRADAFTAVENVFASMSKGDAYNFPVIREAISHEDALYGFKGGFDKAGMALGLKAGGYWPNNLEKHGHINHQSTVFLFDPDTGMVKAMVGGNLLTALRTAAASSVSIKHLARKDARVMGMVGAGHQATFQLRAALEQREFEKVIGWNYHPEMLPNIEKVADEAGVPFEAVPLEGMVEADVVISITSTFAPTIMADHISPGTHIACMGTDTKGKQEIEAALLAQTTVFTDEVAQSISIGEAQHAIAEGMIQQSDVNELGAVINGTHPGRTSDDEITLFDGTGVGLQDLAVAASIVDVAVEKGIATIVEF

SEQ ID NO: 81 - protein, 338 aa, Roseobacter sp. AzwK-3b
MNDLSAQAPKAAQAGNTVTIVPEAEIAGLMTPEAAFDAVEATFAAMARGDAYNFPVIREAIGHADALYGFKSGFDRESLALGLKSGGYWPGNEARGLTNHQSTVILFDADTGRPSALVGGNLLTALRTAAASAVSIRYLARQDAKVLGMIGAGHQSAFQMRAAVQQRSFEKVVGWNYHPEMLSRLADTAAELGLSFEAVSLEELGAQADVIVTITSSFAPSLLDAHVRPGTHLACMGTDTNGKQEVEAGLLARARVFTDEVAQSVTLGEAQHAVAEGLISADDITQLGAVINGIHPGRSSDQEITLFDGTGVGLQDLAVAAAVVRLAREQGVASEVVL

SEQ ID NO: 82 - protein, 321 aa, Rhodobacteraceae bacterium KLH11 scf_1108856220443 genomic scaffold
MIIVPEKEIGALLGRKESYEAVEQVFAAMASGDAYNFPVVREAIGHEDALYGFKGGFDKAGQVLGLKAGGYWPHNLEKRGLINHQSTVFLFDPDTGMPTAMVGGNLLTALRTAAASSVSINHLARKDARVIGMVGAGHQATFQLRAALEQREFEKVIGWNLHPEMLPNIEKVAAEAGLPFEAVELPGMTQADVIVTITSSFAPTLLSDHVADGTHVACMGTDTIGKQEVGTDLITRASVFTDEVAQAITLGESQHAVKAGTKAEADIHQIGAVINGTHTGRSSDDEVTLFDGTGVGLQDLAVASAVVDLAIKQGIAIKVDI

SEQ ID NO: 83 - protein, 321 aa, Rhodobacteraceae bacterium KLH11 scf_1108856220445 genomic scaffold; identical to SEQ ID NO: 82

SEQ ID NO: 84 - protein, 321 aa, Silicibacter sp. TrichCH4B genomic scaffold scf_1113354613205
MYIVPERAIADLMTRDAAFDAVEKVFAAMAAGDAYNFPVVREAIGHEDALYGFKGGFDRAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLSNLEEVATEAGLPFEAVELDGLKEADVIISITSSFDAILKADQVSPGTHIACMGTDTKGKQEVDPQLLVRATVFTDEVAQSISIGEAQHAVAQGLIAEADVAQLGAVINGAHPGRSSAEQITLFDGTGVGLQDLAVAASVVELAVKKGIAIEVDF

SEQ ID NO: 85 - protein, 321 aa, Pelagibaca bermudensis HTCC2601 1100011001308
MLIVHEREIAALMTRDAAFSAVEKVFAAMADAKAYNFPVVREAIGHEDALYGFKGGFDRAGLTLGLKAGGYWPHNLEKRGEINHQSTVFLFDPDTGKAKAMVGGNLLTALRTAAASSVSIRHLARDDAKVLGMIGAGHQATFQLRAALEQRAFEKVIGWNLHPEMLPNLEKVAQEAGVPFEAVELPGMTEADVIITITSAFSPSLMAEHVSPGTHIACMGTDTKGKQEVEAALLSRATVFTDEVAQSVSIGEAQHAVAEGALKAEDIAQLGAVINGSHPGRQSAEEITLFDGTGVGLQDLAVAAAVVDLAVEKGVATEVDF

SEQ ID NO: 86 - protein, 320 aa, Paracoccus sp. J39 ICCT; identical to SEQ ID NO: 46

SEQ ID NO: 87 - protein, 320 aa, Paracoccus sp. J55; identical to SEQ ID NO: 46

SEQ ID NO: 88 - protein, 327 aa, Rhodovibrio salinarum DSM 9154
MTDNHQVVVVPEDLCEALVSRADAFQAVEQVFAAMASGDARNFPVVREATGHAEALFGFKSGFDKAGMALGLKAGGFWPGNADKGLTNHQSTVFLFDPDTGRLQALVAGNYLTAVRTAASSSVSIRHLARPDAKVLGMVGAGHQAQFQLRAAAEQRAFEKVVAWNPHPDMLSKLEAVAREIGLPFEAVSQHELGAQAHVIITITSAFEPLLMRDWIKPGTHIACMGTDTKGKQEVDPELVAGARVFTDEVAQSVQLGETQHAVAQGLLAESDITPIGEVINKTHPGRQSDDEITLFDGTGVGLQDLAVAATAAKLAQQQGKAETVRL

SEQ ID NO: 89 - protein, 335 aa, Colwellia piezophila ATCC BAA-637
MSNSQQNNLPKNKGVSVVSEEVCQQVMGRENAFSAVENVFSAMAKNTAYNFPVIREAIGHEDALYGFKSGFDRDGMVLGLKSGGYWPGNMAKGLTNHQSTVILFDPDTGKLKSLVGGNYLTAVRTAASSAVSIAYLARKDSKVLGMIGAGHQSSFQLRAAVEQRDFEKVVCWNFHPEQIPNLAAVAEELGLPFESVTREELCAQADVIITITSAFEALIDKNWIKPGTHIACMGTDTKGKQEVDAKLLAVASVFTDELAQSITIGEAQHAIAQKLIQQSDIVPIGEVINGTKPGRTSDEQITLFDGTGVGLQDLAVASVAAELAEEKGLATYFQL

SEQ ID NO: 90 - protein, 321 aa, Rubellimicrobium mesophilum DSM 19309 (scaffold version)
MIVVPERIIAGLMTRADAFAAIEAVFAAMARGEARNFPVVREAIGHADALYGFKSGFDRAHLDLGLKSGGYWPGNAAKGLTNHQSTVVLFDADTGRCRALVGGNLLTALRTAAAAAVSVAHLARKDSRVLGIVGAGHQAAFQLRAVAEQRPFERVVAWNRSPEKLKGLACAAEEMGLPFESVSLDRLGAEADVIVTITSSFDAILGDAQVRPGTHLACMGTDTRDKKEVDPTLVARASVFTDEVAQAVTIGECQHAVALGLKGEADIVPLGAVINGDHPGRASEEEVTLFDGTGVGLQDLAVASRVVDLAVQKGLATQVEF

SEQ ID NO: 91 - protein, 321 aa, Maritimibacter sp. HL-12
MLIVPERDIAKLLTRKAAFEAVEKVFASMAKGAARNFPVVREAIGHEDALFGFKGGFDRAGMTLGLKAGGYWPHNMAAHGVINHQSTVVLFDPDTGRLRAMVGGNLLTALRTAAASAVSIKHLARPDAAVLGMIGAGHQAAFQLRAALEQRDLVKVIGWNRNPEKLAGLEAVAAEAGVAFETVDLDGMGEADVIITITSSFAPILEHGHVSPGTHVACMGTDTRGKQEVDPGLLARASVFTDQVAQSVSIGEAQHAVGQGLISEAEIGELGAVINKTLPGRTTDDQITLFDGTGVGLQDLAVAASVVEMAVDQGLAIEVAL

SEQ ID NO: 92 - protein, 321 aa, Methylobacterium sp. L2-4; identical to SEQ ID NO: 39

SEQ ID NO: 93 - protein, 321 aa, Ensifer fredii GR64
MIIVPENQIAGLMTPADCLVAVEEVFASMAKRSAYNFPVIREAIGYADALYGFKSGFDRANLALGLKSGGFWPNNVQKGLANHQSSVFLFDADTGKCRAVVGGNLLTALRTAAASAISIKHLARKDAKVLGMIGAGHQSTFQLRAAVEQCSFEKILAWNFHPEMLSRLEEVARELELPFEAVELDRLGAESDVIISITSSFAPILKASQVRPGTHLACMGTDTKGKQEMEAGLVAAATVFTDEIAQAVTIGECQHAIERKLLSRADITELGAVITGRHPGRSSPDEITLFDGTGVGLQDLAVASAAVAHAVSRGTAIEVDF

SEQ ID NO: 94 - protein, 321 aa, Ponticoccus litoralis DSM 18986
MLIVPEREIADLMTREAAFAAVESVFAAMASGDAYNFPVVREAIGHEDALYGFKGGFDRAGLTLGLKAGGYWPHNLEKRKEINHQSTVFLFDPDTGKARAMVGGNLLTALRTAAASSVSIRHLAREEAKVLGMIGAGHQATFQLRAALEQRPFEKVVAWNLHPEMLPNLEKVAQEADVPFEAVELPGMAQADVIITITSAFAPSLLAEHVSPGTHIACMGTDTKGKQEVEAALLTHATVFTDEVAQSVSIGEAQHAVADGTLKPGDIAQLGAVINGTHPGRQSAEEITLFDGTGVGLQDLAVAASVVDLAVEKGVAIEVDF

SEQ ID NO: 95 - protein, 321 aa, Rhizobium sp. OK494
MIIVPETEIAGLVTPADCFRAVEGVFASMADKSAHNFPVVREAIGHADALYGFKSGFDRKGLALGLKAGGFWPNNVHKGLTNHQSTVFLFDPDTGKCRAVVGGNLLTALRTAAASAISIKYLARKDAKVLGMIGAGHQATFQLRAALAQRPFERIVGWNLHPDMLSRLEEVAKEEGLPFEAVDLDRLGAEADVIISITSSFAPMLKASQVRAGTHLACMGTDTKGKQEVEAEILAAAAVFTDEVAQAVTIGESQHAIERGLIREEAIVEIGAVINGTHPGRTSADQITLFDGTGVGLQDLAVASAAVELALAKGVAIEVDF

SEQ ID NO: 96 - protein, 321 aa, Planktotalea frisia DSM 23709
MWIVPEREIADLLTRDASFDAVEKVFAAMAAGDAYNFPVIREAIGHEDALYGFKGGFDGVGGTLGLKAGGYWPHNLEKRNLINHQSTVFLFDPDTGKVAAMVGGNYLTALRTAAASSVSIKHLARTDAKVMGMVGAGHQATFQLRAALEQREFEKVIGWNYHPEMLPNIEKVANEAGVPFEAVELEGLGEADVVISITSTFAPTIMADHISAGTHIACMGTDTKGKQEVEAALLARATVFTDEVAQSISIGEAQHAIEAGLIQEADVHQIGAVINATHKGRTSDDEITLFDGTGVGLQDLAVSAAIVRMAIEQGVAIEVDF

SEQ ID NO: 97 - protein, 320 aa, Paracoccus denitrificans DSM 415; identical to SEQ ID NO: 4

SEQ ID NO: 98 - protein, 320 aa, Paracoccus halophilus CGMCC 1.6117
MWVVPEKEIAGLMTPEAAFDAIESVFASMARRKAYNFPVVREAIGYEDALYGFKGGFDAAALTLGLKAGGYWPNNQKHGIINHQSTVFLFDPDTGRVAAAVGGNLLTALRTAAASAVSIKHLAPKGASVLGMIGAGHQSVFQMKAAARVNKFERVLGWNPHPEMLGRLADTAAELGLPFEAVELDRLGAEADVIIAITSSFAPLLMDGHVKGPTHIAAMGTDTKGKQELDPALVARARLFTDEIAQSVSIGEYQHVIAGNLVQQDAIGELGAVVTGDNPGREGDEVTIFDGTGVGLQDLAVAAAVVELAKQKGVAQRVEI

SEQ ID NO: 99 - protein, 331 aa, Roseovarius tolerans DSM 11457
MMDQKVETQGIVIVGEEICQEVISRADAFSAVEAVFGAMAKGDAYNFPVVREAIGHADALYGFKGGFDKSGLTLGLKAGGYWPGNMEKGLTNHQSTVCLFDPDTGQLSALVGGNYLTALRTAASSSVSIAHLARKDSRVLGMVGAGHQSAFQLRAAAEQRDFDKVVAWNPHPDMLPRLQAVAEELGLAFEGVSQEELGAQADVIITITSAFEPLLMADWIKPGTHIACMGTDTKGKQEVDPVLFQRATVFADEIAQSISIGEAQHAVAQGLIAEGDITPVGAVINGTHAGRASAEEITLFDGTGVGLQDLAVASVAARIARERGLVTPVTL

SEQ ID NO: 100 - protein, 321 aa, Jannaschia pohangensis DSM 19073
MIIVPESAIANLMTADDAFKAVEAVFAAMSRGDAYNFPVIREAIGHADALYGFKSGFDRAGLNLGLKSGGYWPGNADKGLTNHQSTVFLFDADTGKCRAVVGGNLLTALRTAAAAAVSTAHLAREDARVLGIVGAGHQSTFQLRQVAATRDFERVVAWNRSPEKLDRLAKVAAELGLPFEAVSLETLGAQADVIVTIVSAQAPTLLDAHVRPGTHIACMGTDTKGKQEVEAAILARATVFTDEVAQSVTIGEAQHAVGQGLIAKGDVNELGAVINGTHPGRRSGDEITVFDGTGVGLQDLAVAASVVERAIAEGVAVEVDF

SEQ ID NO: 101 - protein, 329 aa, Ruegeria sp. 6PALISEP08
MKDMPDKPLLIVGEDLCQQLVGRAEAFDAVQNVFAAMARGDAYNFPVIREAIGYADALYGFKSGFDRAGQVLGVKSGGYWPGNMDKGLTNHQSTVFLFDPDTGRLSALVGGNYLTAVRTAASSAVSIAHLARKDAKVLGMVGAGHQSTFQLRAAAEQRDFEKVVAWNPHPEMLPRLGEVAAEIGLEFEAVTQEELGAQADVIITITSAFEPLLMKDWIKPGTHLACMGTDTKGKQEVDAALVSHATVFTDEVAQSISIGEAQHAIADGTLTKVRITSIGSVINNDHPGRTSDDEITLFDGTGVGLQDLAVASVAARLADQSGKAERATL

SEQ ID NO: 102 - protein, 321 aa, Mesorhizobium sp. F7
MIVVSERAVAELITQADCLTAVEKVFASMARGSAYNFPVIREAIGHADALYGFKSGFDRESLALGLKSGGFWPGNSQKGLTNHQSTVFLFDADTGRCKAMVGGNLLTALRTAAASAVSIRHLARRDCRVLGMIGAGHQAAFQLRAALDQRCFERIVAWNFHPEMLGRLAEVAGERGIPFEEVSLDRLGAESDVIVTITSSFSPLLKAMQVRPGTHLACMGTDTKGKQEVEAELLAAATVFTDEVAQAVSIGESQHAIGRGLIRESDIIEIGAVITNAHPGRTSDDEITLFDGTGVGLQDLAVASAAVDLAIAKGAAVEVDF

SEQ ID NO: 103 - protein, 334 aa, Neptunomonas antarctica S3-22; identical to SEQ ID NO: 25

SEQ ID NO: 104 - protein, 321 aa, Oceanicola nitratireducens CGMCC 1.7292
MLIVPEREVAGLMTREAAFTAVEQVFAAMANGNAYNFPVVREAIGHEDALYGFKGGFDRTGLALGLKAGGYWPNNLEKRGMINHQSTVFLFDPDTGKARAMVGGNLLTALRTAAASSVSIRHLAREECKVIGMVGAGHQATFQLRAALEQRAFEKVIGWNMHPEMLPNIEKVAAEAGLPFEAVELDGLRAADVIISITSSFDAILTADHVAPGTHIACMGTDTKGKQEVSPELLSKATVFTDEVAQSVSIGEAQHAVALGLIREADISQLGAVIDGTHPGRQSDEEITLFDGTGVGLQDLAVAAAVVDLAVEKGIAIEVDF

SEQ ID NO: 105 - protein, 321 aa, Sinorhizobium fredii CCBAU 25509
MIIVPENQIAGLMTPADCLVAVEEVFASMAKRSAYNFPVIREAIGYADALYGFKSGFDRSNLALGLKSGGFWPNNVQIGLANHQSSVFLFDADTGKCRAVVGGNLLTALRTAAASAISIKHLARKDAKVLGMIGAGHQSAFQLRAAVEQRSFEKILAWNLHPEMLSRLAEVAMELKLPFKIVDLERLGAESDVIISITSSFAPILKASQVRPGTHLACMGTDTKGKQEMEAELVAAATVFTDEVAQAVTIGECQHAIEKKLLSRDDITELGAVITGRHPGRSSPDEITLFDGTGVALQDLAVASAAVAHAVSRGTAIEVDF

SEQ ID NO: 106 - protein, 321 aa, Leisingera sp. ANG-M6
MYIVPEKAIADLVTREASFDAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQATFQLRAALEQRQFEKVIGWNYHPEMLPNIEKVAAEAGLPFEAVDLPGMTEADVIISITSAFAPSLMADHVSPGTHVACMGTDTKGKQEVEAELLVKASVFTDEVAQSITIGEAQHAVAQGLIQESDVAQIGAVINGTNPGRTSDDQITLFDGTGVGLQDLAVAASVVEVAVEKGIAIEVDF

SEQ ID NO: 107 - protein, 321 aa, Leisingera sp. ANG-M7
MYIVPEKAIADLVTREASFDAVEKVFAAMASGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQATFQLRAALEQRQFEKVIGWNYHPEMLPNIEKVAAEAGVPFEAVELEGMREADVIISITSAFAPSLMADHVSPGTHIACMGTDTKGKQEVEAELLVKSSVFTDEVAQSISIGEAQHAVAQGLIQESDVAQIGAVINGTNPGRTSDDQITLFDGTGVGLQDLAVAASVVEVAVEKGIAIEVDF

SEQ ID NO: 108 - protein, 321 aa, Loktanella maricola DSM 29128
MIVVPEKEIAGLLTRADAFDAVEKVFASMSKGSAYNFPVIREAIGYEDALYGFKGGFDNTGMALGLKAGGYWPNNLEKHGEINHQSTVFLFDPDTGKVKAMVGGNLLTALRTAAASSVSIKHLARKDAKVMGMVGAGHQATFQLRAALEQREFEKVIGWNYHPEMLPNIEKVADEAGVPFEAVELDGLVEADVVISITSTFAPTIMANHIAPGTHIACMGTDTKGKQEVEAALLAQTTVFTDEVAQSISIGEAQHAIAAGLIQQSDVNELGAVINGTHPGRTSDDEITLFDGTGVGLQDLAVASSIVDLAVEKGIATIVEF

SEQ ID NO: 109 - protein, 321 aa, Loktanella sediminum DSM 28715
MIIVPEREIAGLMTRKAAFDAVEKVFAAMSAGDAYNFPVVREAIGHEDALYGFKGGFDQAGLTLGLKAGGYWPNNLEKRNLINHQSTVFLFDPDTGKAKAMVGGNLLTALRTAAASSVSIKHLARKDAKVIGMVGAGHQATFQLRAALEQRDFEKVIGWNLHPEMLPNIEKVAEEAGLPFEAVDLSGMTEADVIISITSSFAPSLMADHVSSGTHIACMGTDTKGKKEVEAALLETATVFTDEVAQSISIGEAQHAIAEGLISQNDVNELGAVINGTHAGRIDEDQITLFDGTGVGLQDLAVAASVVDLAAAKGIAIEVDF

SEQ ID NO: 110 - protein, 321 aa, Tateyamaria sp. ANG-S1
MLIVPEKDIADLMTRQAAFDAVEQVFAAMAAEDAYNFPVVREAIGHEDALYGFKGGFDRAGATLGLKAGGYWPHNLEKRDLINHQSTVFLFDPDTGKPAAMVGGNLLTALRTAAASSVSIKHLARPDAKVLGMIGAGHQATFQLRAALEQRDFERVIGWNYHPDMLPNIAKVAEEAGLPFEAVDLPGMVDADVIISITSAFAPSLMADHVSPGTHIACMGTDTKGKQEVEAALFARATVFTDEVAQSVSIGEAQHAIAAELIEASDIHQIGAVINGAHPGRSGDTDITLFDGTGVGLQDLAVAARVVDLAEKKGIAIHVDF

SEQ ID NO: 111 - protein, 321 aa, Labrenzia alexandrii CECT 5112
MIIVPEKEIAALLGRAEAFEAVESVFAAMSSGVAYNFPVIREAIGHADALYGFKSGFDRSSLALGLKSGGYWPGNADNGLTNHQSTVFLFDADTGKARAVVGGNLLTALRTAAASAVSIKHLARKDAKVLGMIGAGHQSAFQMRAAVEQRSFEKVIGWNLHPEMLSRLEETAAELDLPFEAVDLDRLGAEADVIISITSSFDPILKVSQVTPGTHLACMGTDTKGKQEVEAELVAKATVFTDEVAQSSTIGECQNAVASGLISESDINEIGAVINGNHKGRTSVEEITLFDGTGVGLQDLAVASAVVDLAVEKGIAISVDF

SEQ ID NO: 112 - protein, 338 aa, Roseovarius litoreus DSM 28249
MNDLSAQAPKAAQAGNTVTIVPEAEIAGLMTPEAAFDAVEATFAAMARGDAYNFPVIREAIGHADALYGFKSGFDRESLALGLKSGGYWPGNEARGLTNHQSTVILFDADTGRPSALVGGNLLTALRTAAASAVSIRYLARQDAKVLGMIGAGHQSAFQMRAAVQQRSFEKVVGWNYHPEMLSRLADTAAELGLPFEAVTLEELGAQADVIVTITSSFAPSLLDAHVRPGTHLACMGTDTKGKQEVEAGLLARARVFTDEVAQSVTLGEAQHAVAEGLTSADDITQLGAVINGTHPGRTSDQEITMFDGTGVGLQDLAVAAAVVRLAREQGVASQVVL

SEQ ID NO: 113 - protein, 321 aa, Labrenzia sp. CP4
MIIVPEKEIAGLIGRQESFDAVESVFAAMAGGAAYNFPVIREAIGHADALYGFKSGFDRSSLALGLKSGGYWPGNMAKGLTNHQSTVFLFDADTGKAKAVVGGNLLTALRTAAASAVSIKHLARKDAKVLGMIGAGHQSAFQMRAAVEQRDFEKVLGWNLHPEMLVRLEETANELGLPYESVDLARLGTEADVIISITSSFDPILMEEHVSPGTHIACMGTDTKGKQEVDVALVAKAKLFTDEVAQSATIGECQHAVASGIVSEDNIIEIGAVINGNHPGRTSQSDITLFDGTGVGLQDLAVASAAVDLAIQKGVAIEVDF

SEQ ID NO: 114 - protein, 321 aa, Rhizobium sp. N541; identical to SEQ ID NO: 71

SEQ ID NO: 115 - protein, 320 aa, Paracoccus sp. MKU1
MLVVAEKEIAGLMTPEAAFEAIEAVFASMARRKAYNFPVVREAIGHEDALYGFKGGFDASALTLGLKAGGYWPLNQKHNLINHQSTVFLFDPDTGRVSAAVGGNLLTALRTAAASAVSIKYLAPKGAKVLGMIGAGHQSAFQMRAAANVHRFEKVIGWNPHPEMLGRLADTAAELGLPFEAVDLPRLGAEADVIISITSSFSPLLMNEHVKGPTHIAAMGTDTKGKQELDPALVARARIFTDEVAQSVSIGECQHAIASKLIAEEQIGELGAVVAGDNPGRGDAEVTLFDGTGVGLQDLAVAKAVVELAKHKGVAQEVEI

SEQ ID NO: 116 - protein, 321 aa, Pseudoruegeria marinistellae SF-16
MLIVPEREIANLMTREAAFEAVQKVFAAMASGDAYNFPVVREAIGHEDALYGFKGGFDRAGLTLGLKAGGYWPNNLEKHGMINHQSTVFLFDPDTGRATAMVGGNLLTALRTAAASSVSIAHLAREDARVIGMIGAGHQAKFQLRAALEQRSFEKVIGWNLHPEMLPNLEEVASEAGLPFEAVELDGIRDADVIISITSSFDAILTADQVSPGTHIACMGTDTKGKQEVDPALLARATVFTDEVAQSISIGEAQHAIASGLIAENDIAQLGSVINGTHPGRTSAEQITLFDGTGVGLQDLAVAAAVVDLAARNGSAIEVDF

SEQ ID NO: 117 - protein, 321 aa, Ruegeria conchae DSM 29317
MIIVPEKEIGALLGRNESYEAIEQVFAAMAAGDAYNFPVVREAIGHADALYGFKGGFDRAGMTLGLKAGGYWPNNLETHGLINHQSTVFLFDPDTGRVKAIVGGNLLTALRTAAASSVSINHLARKDAKVIGMVGAGHQAKFQLRAALEQREFEKVIGWNLHPDMLPNIEEVASEAGLPFEAVELPGMVEADVIITITSSFAPTLMSDHVSDGTHVACMGTDTVGKQEVGVDLINRATVFTDEVAQSITLGECQHAVASGSKTETDIRQIGEVINGTHPGRQSDQEVTLFDGTGVGLQDLAVASAVVELAVEQGIAIEVDF

SEQ ID NO: 118 - protein, 321 aa, Labrenzia sp. C1B10
MIIVPEKEIAGLIGRQESFDAVESVFAAMAGGAAYNFPVIREAIGHADALYGFKSGFDRSSLALGLKSGGYWPGNMAKGLTNHQSTVFLFDADTGKAKAVVGGNLLTALRTAAASAVSIKHLARKDAKVLGMIGAGHQSAFQMRAAAEQRDFEKVLGWNLHPEMLVRLEETANELGLPYESVDLARLGAEADVIISITSSFDPILMEEHVSPGTHIACMGTDTKGKQEVDVALVAKAKLFTDEVAQSATIGECQHAVASGIVSEDNIIEIGAVINGNHPGRTSQSDITLFDGTGVGLQDLAVASAAVDLAIQKGVAIEVDF

SEQ ID NO: 119 - protein, 321 aa, Methylobacterium radiotolerans NDB3P7
MIIVPEHAIDGLLTEAECFGAVEQVFASMARRRAGNFPVVREAIGHADALYGFKSGFDRDSLALGLKAGGFWPGNAAKGLTNHQSTVFLFDADTGRCRAVVGGNLLTALRTAAACAISIRHLAREGARVLGMIGAGHQSAFQLRAALAQRPFERVLAWNLHPGMFGRMEAVARERGVPFEVVDLDRLGAEADVVVTITSSFAPILKAAQVRPGTHVACMGTDTRGKQEVEAELLAAATVFTDEVAQSVSLGEAQHAVARGLLAADSIVEIGAVINGDHPGRVSDAEITVFDGTGVGLQDLAVAAVAVDRALAKGLATEVGF

SEQ ID NO: 120 - protein, 345 aa, Colwellia psychrerythraea 34H
MSDSKENHAPENHSHKNSLPVNKGVSVVSEAVCQEVMGRADAFTAVENVFSAMAKNTAYNFPVIREAIGHADALYGFKSGFDRDGMVLGLKSGGYWPGNVQKDLTNHQSTVILFDPDTGQLKSLVGGNYLTAVRTAASSAVSIAHLARKDSKVLGMVGAGHQSTFQLRAAVEQREFEKIVCWNFHPEQIPKLAAVAEELGLPFESVTREELCAQADVIITITSAFEALIDKDWIKPGTHIACMGTDTVGKQEVDAKLLAVAKVFTDELAQSITLGEAQHAIAQKLIQQSDIVPIGEVINGTKTGRTSAEDITLFDGTGVGLQDLAVASVAAELAEAKGQVTYFNL

SEQ ID NO: 121 - protein, 333 aa, Psychrobacter arcticus 273-4
MSEANSVNSNEGLLIVSEDACKSVIDRPSAFIAVENVFASMSRGDAYNFPVIREAIGYADALYGFKSGFDRAGKSLGLKSGGYWPGNAAKGLTNHQSTIFLFNPDNGKLRALVGGNYLTAVRTAAASAVSIAHLARKDSKVLGMVGAGHQSTFQLRAALEQRSFEKVVAWNKNKDRLKNLQAVAEELGVPFEAVEREQLCSEADVIITITSAFEPLLMKEWIKPGTHIACMGTDTVGKQEVDVNLVASATVFTDEIAQSISLGEAQHAIKSGAIKESDITTLGDVINGDHPGRSSDDEITLFDGTGVGLQDLAVASAAAKLALEKGEAQHISL

SEQ ID NO: 122 - protein, 334 aa, Roseovarius sp. 217
MMNTQNEVSADGFVIVGEEICQKIISRADAFGAVEAVFAAMARGDAYNFPVVREAIGHADALYGFKGGFDRSGLSLGLKAGGYWPGNMDKGLTNHQSTVFLFDPDTGRLSALVGGNYLTALRTAASSSVSIAHLARNDSKVLGMVGAGHQSTFQLRAAVEQRAFEKVVAWNPHPDMLPRLGAVAEELGLEFEAVTQEELGAQADVIITITSAFEPLMMADWVKPGTHIACMGTDTKGKQEVDPALFQRAAVFADEIAQSISIGEAQHAVGKGLIAEADITPIGAVINGTHTGRSNAEEITLFDGTGVGLQDLAVASVAAKLAREQGLVTPITLG

SEQ ID NO: 123 - protein, 334 aa, Marinobacter sp. ELB17
METPSEALIQPHQILIISEDTCQKVIGRPEAFQAVESVFSSMAKGSAHNFPVVREAIGHAGALYGFKSGFDREGLVLGVKAGGYWPSNVVKGLTNHQSTVALFDPNTGQLKALVGGNYLTAIRTAASSAVSIAHLARKNAKVLGMIGAGFQSTFQLRAAIEQRDFEKVVAWNTHPEHLTRLADVCREHDLPFEAVSLQALGAQSDVIITITSASEPLLQAGWIKPGTHLACMGTDTKGKQEIDHRLLAQATVFTDEIDQSISIGEAQHAVAARVLRAEQITPIGEVINGSHQGRQSEQEITLFDGTGVGLQDLAVASAAASIAEARGLVQRVTL

SEQ ID NO: 124 - protein, 321 aa, Rhizobium leguminosarum bv. trifolii WSM597
MIIVPESAIGELVSLGDCVDAVEKTFVSMAERSAHNFPVVREAVGYADALFGFKSGFDREGLALGLKAGGFWPNNSDKGLTNHQSTVFLFDPETGRCRAVVGGNLLTALRTAAASAISIKHLARRDAKVLGMVGAGHQASFQLRAAVQQRQFEKVVAWNYHPEMLPKLAAVAKELAVPFEAVDLERLGDEADVIITITSSFQPILKASQIRPGTHLACMGTDTKGKQEVDPALVAAATLFTDEIAQAISIGECQHAVAQGMIAPIDIAEIGAVINGQESGRTSPEEVTLFDGTGVGLQDLAVAQAAVELALARGIAVEVDF

SEQ ID NO: 125 - protein, 321 aa, pMeth_A285
MYIVPEQEIADLMTRKAAFDAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARKDAKVIGMIGAGHQAKFQLRAALEQREFEKVIGWNLHPEMLPNLQEVADEAGLPFEAVELEGLREADVIISVTSSFDAILKVDQVSPGTHIACMGTDTKGKQEVDPQLLVTADVFTDEIAQSVSIGEAQHAVAQGLIKEADVAQIGAVINGTNPGRTSDGQITLFDGTGVGLQDLAVAASVVERAVEAGIAIEVDF

SEQ ID NO: 126 - protein, 325 aa, Roseobacter litoralis Och 149
MSKGLLIVGEDMCAEVVSSADAFTAVEAVFGAMAKGDAYNFPVIREAIGYADALYGFKSGFDKAGKTLGVKSGGYWPGNMDKGLTNHQSTIFLFDPDTGMLEALVGGNYLTAVRTAASSSVSIAHLARKDAKVLGMVGAGHQSTFQLRAAAEQRSFEKVVAWNPHPDMLPRLGAVAEELGLEFEAVTQEELGAQADVIITITSAFEPLLMKDWIKPGTHIACMGTDTKGKQEVDPELLASATVFADEIAQSITIGEAQHAVASGHLSESDITPIGAVINGTHAGRSSDQEITLFDGTGVGLQDLAVASVAAREAESRGKATRIAL

SEQ ID NO: 127 - protein, 321 aa, Octadecabacter antarcticus 307
MYIVPESAIADILTRPDAFDAVEKVFAAMSAGDAYNFPVIREAIGHEEALYGFKGGFDGVGKSLGLKAGGYWPHNLEKRGIINHQSTVFLFDPDTGKVAAMVGGNLLTALRTAAASSVSIKHLARKDAKVMGMIGAGHQAKFQLRHALETHNFEKVIGWNYHPEMLPSLAEVAAEFDLPFEAASLKGMVEADVVISMTSSFNPIFGAAHISDGTHIACMGTDTVGKQECDTDLIVKATIFTDEVAQSVTLGETQHAVAAGLKSRDDIFELGAVINGTHAGRKSENEITLFDGTGVGLQDLAVSASIVEIAKAKGIGMEVDF

SEQ ID NO: 128 - protein, 321 aa, Methylopila sp. M107
MLIVPENKVAELINTAECFSAVENVFASMASKSANNFPVVREAIGHADALYGFKSGFDRETLALGVKSGGFWPGNAARGLVNHQSSIFLFDADTGRCRAVVGGNLITAIRTAAASAVSIKHLARKDAKTIGMIGAGHQSAFQLRAALEQRPFDRVLGWNVEPKMLQRLRDVADERGVAFEAVGLDRLGAEADVIITITSSFAPILKASHIRPGIHLACMGTDTRGKQEVEAELTASAILFTDEIVQAVTIGECQHAVAAGLVSQDEIAELGAVINGSDPGRRSDEEITLFDGTGVGLQDLAVATRVVDRAIETGAAIEVEY

SEQ ID NO: 129 - protein, 321 aa, Loktanella sp. SE62
MIIVPEAAIADLITRADAYRAVENVFASMSKGRAYNFPVIREAIGHADALYGFKSGFDRDGLALGMKSGGYWPRNADNGLTNHQSTVFLFDADTGKCRAVVGGNLLTALRTAAASAVSINHLARQDAKVLGMIGAGHQSAFQLRAAVEQRDFDRIVGWNYHPDMLPRLAKVAAEVGLPFEAVSLDELGAQADVIISITSAFAPSLMDADVRPGTHIACMGTDTKGKQELDPALLARATIFTDEIAQSVTIGEAQHAISAKLITESDISEIGAVINGTHPGRSDAEEITIFDGTGVGLQDLAVAAAVVDLAVAKGVATEVDF

SEQ ID NO: 130 - protein, 321 aa, Phaeobacter gallaeciensis ANG1 (ANG1); identical to SEQ ID NO: 24

SEQ ID NO: 131 - protein, 320 aa, Rhodobaca barguzinensis DSM 19920
MWIVPESAIPGLVDEQSAFDAIEATFAAMSRGDAYNFPVVREALGEGRQYGFKSGLDRVGALLGVKAGGYFPGNAERGIPNHQSTVYLFDPDSGKPTAMVGGNLLTALRTAAASAISIKHLARADSEVLGMVGAGHQSAFQMRAAVRARGFKKVIGWNYHPEMLSRLADTAAELGLPFEAVSLEQLGAEADVIITITSSFDAIVQDAHIRPGTHLACMGTDTKGKQEVEAAILARASVFTDEVAQSVSIGEAQHAVAAGLLSEGAITEIGAVINGAHAGRAGAEEITVFDGTGVGLQDLAVASRAVELAVERGLAQQIAF

SEQ ID NO: 132 - protein, 330 aa, Mameliella alba DSM 26384
MKDMPETQGLVIVGEAECERLVGRKDAFDAVEAVFGAMAKGDAWNFPVVREAIGYADALYGFKSGFDKAGKVLGVKSGGYWPGNMDKELTNHQSTVFLFDPDTGQLAALVGGNYLTAVRTAASSAVSIAHLARKDAKVLGMVGAGHQSQFQLRAAAEQRDFEKVVAWNPHPEMLPKLGAVAEELGLPFEAVTQEQLGAQADVIITITSAFEPLLMKDWIKPGTHIACMGTDTKGKQEVDAALVAAATVFTDEVAQSISIGEAQHAIAEGFLTEDRITPIGAVINGAHPGRSSDDEITLFDGTGVGLQDLAVASVAARLAEEEGSAQRVSL

SEQ ID NO: 133 - protein, 320 aa, Paracoccus denitrificans DSM 15418; identical to SEQ ID NO: 4

SEQ ID NO: 134 - protein, 328 aa, Ruegeria halocynthiae MOLA R1/13b
MNTQTDGLLIVGEDLCEQLVGRSQAFDAVQSVFAAMASGGARNFPVIREALGYADALYGFKSGFDRDGQVLGVKSGGYWPGNADKGLTNHQSTVFLFDPDTGQLSALVGGNYLTAVRTAASSAVSIAQLARKDAKVLGMVGAGHQSAFQLRAAAEQRDFEKVVAWNPHPDMLPRLAAVADEIGLEFEAVSQQELGAQADVIITITSAFEPLLMKDWIKPGTHLACMGTDTKGKMEVDPELVTSATVFTDEVAQSLTIGEAQHAAGTGALTESAITPIGAVINGDHPGRTGADEITLFDGTGVGLQDLAVASVAARLADEAGLAQRVAL

SEQ ID NO: 135 - protein, 320 aa, Paracoccus denitrificans DSM 413; identical to SEQ ID NO: 4

SEQ ID NO: 136 - protein, 321 aa, Roseivivax isoporae LMG 25204
MIIVPEREIAALMTREAAYDAVETVFAAMAAEDAYNFPVVREAIGHEDALYGFKGGFDRAGKVLGLKAGGYWPNNLERRGIINHQSTVFLFDPDTGRAHAMVGGNLLTALRTAAASSVSINHLARADARVIGMVGAGHQATFQLRAALAQRPFEKVIGWNLHPEMLPNLEKVADEAGLPFEAVDLPGLTEADVIVTITSSFAPSLMAAHVAPGTHLACMGTDTKGKQEVEAALLARATVFTDEVAQSVAIGEAQHAVAQGLIAEGDVTPIGAVINGTHPGRRSDEEITLFDGTGVGLQDLAVAARVVELAVEAGVAVEVDF

SEQ ID NO: 137 - protein, 321 aa, Citreicella thiooxidans DSM 10146
MLIVPEREIGALMTRASAFEAVEKVFAAMASGEAYNFPVIREAIGHEDALYGFKGGFDRAGLTLGLKAGGYWPNNLEKFRVINHQSTVFLFDPDTGKVAAMVGGNLLTALRTAAASSVSIAHLARRDAKVMGMVGAGHQATFQLRAALEQRPFEKVIGWNLHPEMLPNIETVADEAGLPFEAVALEGMREADVIVSITSSFAPSLMAAHVSPGTHLACMGTDTRGKQEVEAALLAVATVFTDEVAQSVSIGEAQHAVAEGLISESDVHQIGAVINGSHPGRRSDEEITLFDGTGVGLQDLAVAAAVVDLAVEKGIAIEVDV

SEQ ID NO: 138 - protein, 321 aa, Citreicella thiooxidans DSM 10146
MLIVPEREIADLMTREAAFSAVEQVFASMAAGDAYNFPVVREAIGHEDALYGFKGGFDRAGLTLGLKAGGYWPHNLEKRGMINHQSTVFLFDPDTGKAKAMVGGNLLTALRTAAASSVSIRHLAREDAKVIGMVGAGHQATFQLRAALEQRDFDKVIGWNLHPEMLPNLEKVAAEAGLPFEAVELEGMRAADVIISITSSFDAILMEEHVAPGTHIACMGTDTKGKQEVAPALLAKAAVFTDEVSQSVSIGEAQHAVAQGLIREADIAQLGAVINGAHPGRRSAEEITLFDGTGVGLQDLAVAAAVVDLAVEKGIAIEVDF

SEQ ID NO: 139 - protein, 321 aa, Antarctobacter heliothermus DSM 11445
MLIVPEREIANLMTREAAFDAVEKVFAAMASGDAYNFPVVREAIGHEDALYGFKGGFDRAGLTLGLKAGGYWPNNLEKRGLINHQSTVFLFDPDTGMVKAMVGGNLLTALRTAAASSVSIKHLARKDAKVLGMIGAGHQATFQLRAALEQRSFDKVIGWNYHPEMLPNIEKVASEAGVPFEAVDLPGMRAADVIISITSAFGPSLMADHVSPGTHVACMGTDTKGKQEVEAALLARAAVFTDEVAQSVSIGEAQHAVAQGLIQDSDIAQLGAVINGSHPGRISDDQITLFDGTGVGLQDLAVAAAVVDLAVAQGIAIEVDF

SEQ ID NO: 140 - protein, 321 aa, Nitratireductor sp. ZZ-1
MHIVSEATCREIMGRDDAFAAVEAIFSAMARGDAYNFPVIREAIGHADALYGFKSGFDRAGMVLGLKSGGYWPGNEKKGLTNHQSTVFLFDPDSGRPMAMVGGNHLTALRTAAASAVSIKHLARRDARVLGMVGAGFQSAFQMRAAVAQRDFDKVVGWNLHPEMLGRLEATAAELGLPFEAVDLDRLGAEADVIITITSSFAPILSLAQVRPGTHLACMGTDTKGKQEVDAALVAAATLFTDEVAQAAAIGECQHAVAAGLVDAAAITPIGAVIDGQHPGRSSPDEITLFDGTGVGLQDLAIASVAVAKAIDKGMAQSVAV

SEQ ID NO: 141 - protein, 321 aa, Rhizobium sp. CNPSO 671
MIIVPERAIADLIGSAECFTAVEHVFAAMARKSAYNFPVIREAIGYADALYGFKSGFDRESLSLGLKSGGFWPKNAESGLTNHQSTVFLFDADTGRCRAVVGGNLLTALRTAAASAISIKYLAREDAKILGIIGAGHQSTFQLRAAVQQRNFEKVVAWNYHPEMLTRLEEVAREIGLPFEAVDLDRLGAEADVIISITSSFSPSLMASQVRPGTHLACMGTDTKGKQEVDAKLVAASSIFTDEVAQAITIGECQHAIADGMIAAEDILEIGAVITGDVKGRRSADDITLFDGTGVGLQDLAVASAVVDLAVSKGVAIEVDF

SEQ ID NO: 142 - protein, 327 aa, Pseudomonas stutzeri NP_8HO
MQTQSPLLIVPEHLIADLISAQDCFAAVEQVFAAMARDTAYNFPVIREAIGHANALYGFKSGFDRESLALGLKSGGFWPRNADRGLTNHQSTIFLFDADTGRCRAVVGGNLLTALRTAAASAVSIRHLARPDARVLGMIGAGHQSTFQLRAALDQRDFDRVVGWNLNPADLDRLAKVADERGIPFQAVDLDQLGAQADVIITITSSFAPILQAAQVRPGTHLACMGTDTKGKQEVEAALLGKASVFTDEVAQSVTIGEAQHAVAQGLIAPDDITQIGAVINGDRPGRVSDDQITLFDGTGVGLQDLAVASAAVDLAVERGIAIAVQI

SEQ ID NO: 143 - protein, 321 aa, Ruegeria sp. ANG-R
MIIVPEKEIATLLGRTESYDAVEQVFAAMAAGDAYNFPVVREAIGHANALYGFKGGFDRAGMTLGLKAGGYWPNNLETHGLINHQSTVFLFDPDTGRVRAVVGGNLLTALRTAAASSVSINHLARKDAKVIGMVGAGHQATYQLRAALEQRSFEKVIGWNLHPEMLPNIANIASEAGLRFEAVELPGMVEADVIITITSSFAPILMSDHVSNGTHVACMGTDTVGKQEVGVDLITRATVFTDEVAQSITLGECQHVVAEGSKTEADIRQIGEVINGTHPGRQTDEEVTLFDGTGVGLQDLAVAGAVVDLAVERGIAIEVDF

SEQ ID NO: 144 - protein, 330 aa, Mameliella alba CGMCC 1.7290; identical to SEQ ID NO: 132

SEQ ID NO: 145 - protein, 321 aa, Pseudorhodobacter antarcticus CGMCC 1.10836
MWIVPEAKIAGLMDRATCFAAIEGVFGAMARGDAYNFPVIREAIGHADALYGFKSGFDRAGLALGLKSGGYWPGNEAKGLTNHQSTVVLFDPDTGRVKALVGGNLLTALRTAAASAVSIKHLARPDAKVLGMVGAGHQSAFQMRAAVEQRAFEKVVGWNFHPEMLDRLAGVAAELGLPFEAVSLDELGAQSDVIITITSSHKPILRSAQVKAGTHIACMGTDTKGKQEVDDLLVARATVFTDEVAQAISIGECQHAIASGLMAEAEIAELGAVINGSHKGRTSAEEVTLFDGTGVGLQDLAVAAAVVELAIAKGIAIEVDF

SEQ ID NO: 146 - protein, 321 aa, Loktanella sp. DSM 29012
MLIVPEREISNLMTRDAAFEAVEKAFAAMASEDAYNFPVIREAIGHEDALYGFKGGFDRAGLTLGLKAGGYWPHNLEKRGEINHQSTVFLFDPDTGKAKAMVGGNLLTALRTAAASSVSIKHLARKDAKVLGMIGAGHQATFQLRAALETHRFKKVIGWNFHPDMLPNIEKVANEAGVPFEAVDLPSMRDADVIISITSAFAPSLMADHVSPGTHVACMGTDTKGKQEVEAALLARASVFTDEVAQSISIGEAQHAIAEGLIKESDVAQLGAVINGTHKGRASDDEITLFDGTGVGLQDLAVAASVVDLAVAKGIAIEVDF

SEQ ID NO: 147 - protein, 320 aa, Paracoccus thiocyanatus ATCC 700171
MLVVPEKQIAGLMTPEAAFEAIEAVFASMARRKARNFPVVREAIGHEDALYGFKGGFDGVALVLGLKAGGYWPLNQKHGLINHQSTVFLFDPDTGRVAAAVGGNLLTALRTAAASAVSIKYLAPKGAKVLGMIGAGHQSTFQMRAAANVHRFEKVIGWNPHPEMLSRLADTATELGLPFEAVELDRLGTEADVIISITSSFSALLMDQHVKGPTHIAAMGTDTKGKQELDPALVARARIYTDEIAQSVSIGECQHAIAAGLIAQEAIRELGAVVAGRGPGRDGAEVTLFDGTGVGLQDLAVAAAVVELAKHKGVAQEVEI

SEQ ID NO: 148 - protein, 321 aa, Rhodovulum sulfidophilum TUT; identical to SEQ ID NO: 64

SEQ ID NO: 149 - protein, 321 aa, Roseovarius sediminilitoris DSM 29439
MFIVPEKEIAALVTRKDNFDAVEQVFASMAGGSAYNFPVIREAIGHADALYGFKSGFDRAALNLGLKSGGYWPGNAEKGLTNHQSTVFLFDADTGKCRAVVGGNLLTALRTAAAAAVSVAHLARKDSKVLGMIGAGHQATFQLQAVAEQRNFEKVVAWNRTSEKLASLQNVADDLGLPFESVSLDELGAQADVIVTIVSSQAAILNDAQVKPGTHIACMGTDTKGKQEVDANLVARATVFTDEIAQSISIGEAQHAIADGSLKQADISEIGAVINGDHPGRTSDDEVTLFDGTGVGLQDLAVASKVVDLAIEKGIAIEVDF

SEQ ID NO: 150 - protein, 321 aa, Leisingera sp. ANG-M1
MYIVPEKEIAGLMTREAAFDAVEKVFAAMASGDAYNFPVVREAIGHEDALYGFKGGFDRAGLTLGLKAGGYWPNNLEKRGLINHQSTVFLFDPDTGKAKAMVGGNLLTALRTAAASSVSIKHLARKDAKVIGMIGAGHQAKFQLRAALEQRQFEKVIGWNLHPDMLPNLQEVADEAGLPFEAVELDGMREADVIISITSSFDAILNTAQVSPGTHIACMGTDTKGKQEVDPQLLVAADVFTDEVAQSISIGETQHAVAQGLIQEADVAQIGAVINGTNPGRTSGDQITLFDGTGVGLQDLAVAASVVDLAVEQGIAIEVDF

SEQ ID NO: 151 - protein, 333 aa, Roseovarius azorensis DSM 100674
MMNTHAEATADGFVIVGEDICEKVISRADAFDAVEAVFAAMARGDAYNFPVVREAIGHADALYGFKGGFDRTGLSLGLKAGGYWPGNMARGLTNHQSTVFLFDPDTGRLSALVGGNYLTALRTAASSSVSIAHLAREDSKVLGMVGAGHQSTFQLRAAVEQRDFEKVVAWNPHPEMLPRLGAVAEELGLAFEAVSPEDLGAQADVIITITSAFEPLIMADWIRPGTHIACMGTDTKGKQEVDPALFSRATVFADEVAQSISIGEAQHAVGQGVIAESDITPVGAVINGTHGGRGSDEEITLFDGTGVGLQDLAVAAVAARLAREQGLVTPVTF

SEQ ID NO: 152 - protein, 321 aa, Sulfitobacter pseudonitzschiae DSM 26824
MLIVPEREIANLMTRAAAFDAVEQVFAAMAAGDAYNFPVVREAIGHEDALYGFKGGFDRAGLTLGLKAGGYWPNNLEKRNLINHQSTVFLFDPDTGRARAMVGGNLLTALRTAAASSVSIKHLARKDARVIGMVGAGHQATFQLRAALEQRDFDKVIGWNYHPEMLPNIEKIAREAGVPFQAVDLPGMVEADVIISITSAFSPSLMADHVAPGCHLACMGTDTKGKQEVEAALLARATVFTDEVAQSVSIGEAQHAVAEGLIAESDVHQLGAVINGTHAGRVSDDQITLFDGTGVGLQDLAVAAAVVDLAVAQGIAIEVDF

SEQ ID NO: 153 - protein, 321 aa, Ruegeria sp. CECT 5091
MIIVPEKEIGALLGRKESYSAVEQVFAAMASGDAYNFPVVREAIGHADALYGFKGGFDRAGMTLGLKAGGYWPNNLETHGLINHQSTVFLFDPDTGRVKAIVGGNLLTALRTAAASSVSINHLARKDAKVIGMVGAGHQATFQLRAALEQRDFEKVIGWNLHPEMLPNIEKVANEAGLPFEAVELPGLTEADVIVTITSSFEPTLLSEHVSDGTHVACMGTDTVGKQEVGADLVIRASVFTDEVAQAITLGESQHAVAAGDKAEADIHQIGAVINGTHAGRNSDDEVTLFDGTGVGLQDLAVASAVVDLAVKQGIAIEVDF

SEQ ID NO: 154 - protein, 322 aa, Pseudoruegeria haliotis DSM 29328
MLIVPEREIGNLMTRAAAFDAVEGVFAAMASKNAYNFPVVREAIGYEDALYGFKGGFDRAGKTLGLKAGGYWPNNLEKFDLINHQSTVFLFDPDTGRVKAIVGGNLLTALRTAAASSVSIKHLAREDAKVLGMIGAGHQATFQLRAALEQRSFEKVVGWNYHPEMLPNIEKVAAEAGLPFEAAQLDRLGQEADVVISITSAFAPSLMADHVSPGTHIACMGTDTKGKQELDAALLPRATVFTDEVAQSVSIGEAQHAVAQGLIAQSDVQQIGAVINGTHPGRTSAEEITLFDGTGVGLQDLAVAASVVDLAVQQGIAIEVDF

SEQ ID NO: 155 - protein, 320 aa, Psychrobacter sp. ENNN9_III
MSEANSVHSDEGLLIVSEDACKSVIDRPSAFTAVENVFASMSRGDAYNFPVIREAIGYADALYGFKSGFDRAGKSLGLKSGGYWPGNADKGLTNHQSTIFLFNPDNGKLRALVGGNYLTAVRTAAASAVSIAHLARKDSKVLGMVGAGHQSTFQLRAALEQRNFEKVVAWNNNKDRLKNLQAVAEELGVPFESVEREQLCSEADVIITITSAFEPLLMKEWIKPGTHIACMGTDTVGKQEVDVNLISAATVFTDEIAQSISLGEAQHAIKSSAIKESDITTLGDVINGEHPGRSSDDEITLFDGTGVGLQDLAVASAAAK

SEQ ID NO: 156 - protein, 317 aa, Pararhodobacter aggregans DSM 18938
MLVVPERLIAGLMGPDEAFEAVAEVFRQTAGGAARNFPVVREALGGGRQYGFKSGMGPGALGVKAGGYFPGNAARGITNHQSVVTLFDPETGRPEAMIGGNLLTALRTAAAAAVSIDALARPGARVLGIVGAGHQAAFQLRAAARVRRFERVIAWNRTPERLAGLAAVAEELGLPFEAVPLAGMREAEVIVTITSSPAYALAAAHVSPGTHLACMGTDTIGKQEVEPALLGAARVFTDEPAQSVTLGEAQHAVAQGLLDPARIVPLGAVLTGEAPGREDPDQITLYDGTGVGLQDLAVAARVLALAKARGLAIPVEI

SEQ ID NO: 157 - protein, 321 aa, Rhodovulum kholense DSM 19783
MFVVPESEIAGLVSPAQCFEAVEAVFSAMARDEAYNFPVIREAIGHADALYGFKSGFDRAGKVLGLKSGGYWPGNVEKGLTNHQSTVVLFDPDTGRPAALVGGNLLTALRTAAASAVSIRHLARCDSRVLGLLGAGHQSAFQMRAAVAERPFEKVIGWNYHPEMLPRLAETAVELGLPFEAVSLEDLGAQADVIVTISSSVAAQLLDAHVRPGTHLACMGTDTRGKQEIDAAIFARARVFTDEVAQSVEIGEAQHAVAAGLIGAGDIVQIGAVINGTVPGRQSEDDITLFDGTGVGLQDLAVAARAVAAARAKGVAVEVDL

SEQ ID NO: 158 - protein, 321 aa, Rhizobium yanglingense LMG 19592
MIIVPESAIGELVSLEDCVDAVEKVFVSMAERSAHNFPVVREAIGYADALFGFKSGFDRKGLALGLKAGGFWPNNADKGLTNHQSTVFLFDPETGRCRAVVGGNLLTALRTAAASAVSIKHLARNDAKVLGMVGAGHQASFQLRAAVQQRQFEKVVAWNYHPDMLPKLAAVAEELGIPFEAVNLDRLGAEADVIITITSSFQPILKASQIKPGTHLACMGTDTKGKQEVDVALVAGATLFTDEIAQAISIGECQHAIAQGMIAPIDIAEIGAVINGQKPGRTSPDEITLFDGTGVGLQDLAVAQAAVGLALARGTAVEVDF

SEQ ID NO: 159 - protein, 321 aa, Labrenzia sp. C1B70; identical to SEQ ID NO: 118

SEQ ID NO: 160 - protein, 320 aa, Starkeya novella DSM 506 chromosome
MYVVAEKDIAGLMTPEAAFEAIEAVFASMARRQAYNFPVVREAIGHADALYGFKGGFDGAGLALGLKAGGYWPHNQERGLINHQSTVFLFDPDSGRVSAAVGGNLLTALRTAAASAVSIKYLAPKGAKVLGMIGAGHQSAFQMRAAARVHPFEKVIGWNPHPEMLGRLSDTAAELGLPFEAVELERLGEEADVIISITSSFGPLLMDDHVKGPTHIAAMGTDTKGKQELDPGLVARARLFTDEIAQSVSIGEYQHAVAQGLITQDRIGELGAVVTGDDAGRGDAEVTIFDGTGVGLQDLAVAAKVVELAKQKGIAQQVEV

SEQ ID NO: 161 - protein, 321 aa, Ruegeria mobilis 45A6
MYIVPERAIADLMTRDAAFDAVEKVFAAMAAGDAYNFPVVREAIGHEDALYGFKGGFDRAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLPNLEEIATEAGLPFEAVELDGLKEADVIISITSSFDAILKADQVSPGTHIACMGTDTKGKQEVDPQLLVRATVFTDEVAQSTSIGEAQHAVAQGLIAEADVAQLGAVINGAHPGRSSAEQITLFDGTGVGLQDLAVAASVVELVVKKGIAIEVDF

SEQ ID NO: 162 - protein, 321 aa, Oceaniovalibus guishaninsula JLT2003
MIIVPEAAIANLVTPEASFAAVEKVFASMAAKSAYNFPVIREAIGHADALYGFKSGFDRAALNLGLKSGGYWPGNADKGLTNHQSTVFLFDADTGRCRAVVGGNLLTALRTAAAAAVSVAHLARRDAKVLGIVGAGHQAAFQLRAVAAQRPFERVVAWNRSPEKLSGLREVAEGLGLAFETVSLDDLGAQADVIVTITSSFDAILGADQVRPGTHLACMGTDTKGKQEVDAALLGRATVFTDEIAQSTTIGEAQHAIADLTLRLEDIVELGAVINGDHPGRSSDDEITLFDGTGVGLQDLAVAAAVVDLAVERGVATEVEF

SEQ ID NO: 163 - protein, 321 aa, Loktanella vestfoldensis DSM 16212
MIIVPEREIAGLLGRADAYMAVEAVFAAMASGDARNFPVIREAIGHADALYGFKSGFDRAGLALGLKSGGYWPGNAAKGLTNHQSSVFLFDADTGKCRAVVGGNLLTALRTAAAAAVSINHLARVDARVLGIVGAGHQSVFQLRAALEQRDFTRVVAWNRDPAKLARLSDVAAEHGLPFAAVSLAELGAAADVIITIVSAHEPLLMDAHIRPGTHISCMGTDTKGKQEIDAAIFARASVFTDEIAQSTSIGEAQHAVAAGIISADRITALGAVINGTHQGRTSADEITIFDGTGVGLQDLAVASAVVDLAVTQGVATIVDF

SEQ ID NO: 164 - protein, 321 aa, Rhizobium etli bv. mimosae Mim1
MIIVPESAIGELVSLEDCVDAVEKVFVSMAERSAHNFPVVREAIGYQDALFGFKSGFDREGLALGLKAGGFWPNNADKRLTNHQSTVFLFDPETGRCRAVVGGNLLTALRTAAASAVSIKHLARRDAKVLGMVGAGHQASFQLRAAMQQRPFEKVVAWNYHPEMLPKLAAVAQELAVPFEAVDLDRLGGEADVIITITSSFQPILKALQIKPGTHMACMGTDTKGKQEVDAALVAEATLFTDEIAQAISIGECQHAVARGMIAPIDIVEIGAVINGQQPGRTSPDQITLFDGTGVGLQDLAVAQAAVGLALARGMAVEVDF

SEQ ID NO: 165 - protein, 321 aa, Methylobacterium komagatae DSM 19563
MIIVPENRIDGLLTEADCFTAVEKVFASMARRTAGNFPVVREAIGHADALYGFKSGFDRESLALGLKAGGFWPGNAAKGLTNHQSTVFLFDADTGRCRAVVGGNLLTALRTAAASAISIKHLARKDARVLGMIGAGHQSAFQLRAALAQRPFERVLAWNLHPGMFGRMEAVAREHGVPFEVAELDRLGAEADAIVTITSSFAPILKASHVKPGTHIACMGTDTKGKQEVEAELLAAATVFTDEVAQSVSIGEAQHAIGRGLLTEGAIVEIGAVINGDHPGRTSDEEITLFDGTGVGLQDLAVASAAVDLAVAKGLAVEVEF

SEQ ID NO: 166 - protein, 321 aa, Rhizobium tropici YR635
MIIVPETEIAGLVTPADCFRAVEGVFASMADKSAYNFPVIREAIGHADALYGFKSGFDRKGLALGLKAGGFWPNNVHRGLTNHQSTVFLFDADTGKCRAVVGGNLLTALRTAAASAISIKYLARKDAKVLGMIGAGHQATFQLRAALAQRSFERIVGWNLHPDMLSRLEEVAKEEGLPFEAVDLDRLGAEADVIISITSSFAPMLKASQVRAGTHLACMGTDTKGKQEVEAEILAAAAVFTDEVAQAVTIGESQHAIERGLIREEAIVEIGAVINGTHPGRTSADQITLFDGTGVGLQDLAVASAAVELALAKGVAIEVDF

SEQ ID NO: 167 - protein, 321 aa, Aurantimonas altamirensis DSM 21988
MIIVPERDIAGLIGPADCFVAVEGVFAAMARRTARNFPVVREALGHADALYGFKSGFDGESLALGLKSGGFWPGNMARGLTNHQSAVFLFDADTGQCRAIVGGNRLTALRTAAASAISIKYLARQDARTLGIIGAGHQSTFQLEAALEQRAFEKIVGWNVEPEMLSKLEEVAARRGLPFERVDLDGLGAQADVIITITSSFAPILKVAQVRPGTHIACMGTDTVGKQEVEAELVARASVFTDEVAQAVTLGESQHAVAAGLVDAGSIVEIGQVVTGGHAGRTTPEEITLFDGTGVGLQDLAVASAIVDLAVRKGIATEVEF

SEQ ID NO: 168 - protein, 321 aa, Sulfitobacter sp. MCCC 1A00686; identical to SEQ ID NO: 152

SEQ ID NO: 169 - protein, 321 aa, Methylobacterium sp. 13MFTsu3.1M2
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFEGVLAWNLHPGMFGRMEAVAREHGVPFEAVDLDRLGSEADVVVTITSSFAPILKAAQVRPGTHLACMGTDTRGKQEVEAELLAGATVFTDEVAQSVSIGEAQHAVARGLLAADSIVEIGAVINGDHPGRVSESEITLFDGTGVGLQDLAVAAVAVDRAVAKGLATEVDV

SEQ ID NO: 170 - protein, 321 aa, Methylobacterium sp. 275MFSha3.1
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFDRVLAWNLHPGMFGRMEAVAREHGVPFEAVDLDRLGSEADVVVTITSSFAPILKAAQVRPGTHLACMGTDTRGKQEVEAELLAGATVFTDEVAQSVSIGEAQHAVARGLLAADAIVEIGAVINGDHPGRVSESEITLFDGTGVGLQDLAVAAVAVDRAVAKGLATEVDF

SEQ ID NO: 171 - protein, 320 aa, Paracoccus pantotrophus DSM 11073; identical to SEQ ID NO: 45

SEQ ID NO: 172 - protein, 321 aa, Marinovum algicola DSM 10251
MFIVPERDIADLMTREAAFDAVEKVFAAMASGDAYNFPVVREAIGHEDALYGFKGGFDRAGLTLGLKAGGYWPNNLEKRGIINHQSTVFLFDPDTGKAKAMVGGNLLTALRTAAASSVSIKHLARKDAKVIGMVGAGHQAKFQLRAALEQRDFEKVIGWNFHPEMLPNLEEVASEAGLPFEAVALEGLAEADVIISITSSFDAILHADHVAPGTHIACMGTDTKGKQEVETALLGKATVFTDEVAQSISIGEAQHAIESQILRAEDITQVGAVINGTHPGRISDDEITLFDGTGVGLQDLAVAAAVVDLAVAKGLAIEVDF

SEQ ID NO: 173 - protein, 320 aa, Paracoccus versutus DSM 582
MLVVAEKEIAGLMTPEAAFEAIEAIFASMARRKAYNFPVVREAIGHEDALYGFKGGFDASALVLGLKAGGYWPNNQKHNLINHQSTVFLFDPDTGRVTAAVGGNLLTALRTAAASAVSIKYLAPKGAKVLGMIGAGHQSAFQMRAAANVHPFEKVIGWNPHPEMLSRLADTAAELGLPFEAVELDRLGTEADVIISITSSFSPLLMDQHVKGPTHIAAMGTDTKGKQELDPALVARARIFTDEVAQSVSIGECQHAIASGLIREDQIGELGAVVAGDHPGRVDAEVTLFDGTGVGLQDLAVAQKVLEIAKEKGLAQEVEI

SEQ ID NO: 174 - protein, 321 aa, Thalassobius aestuarii DSM 15283
MLIVPERDIADLMTRAAAFEAVEQVFAAMASKDAYNFPVVREAIGHEDALYGFKGGFDRAGLTLGLKAGGYWPNNLEKRGLINHQSTVFLFDPDTGMVRAMVGGNLLTALRTAAASSVSIKHLARKDAKVLGMIGAGHQATFQLRAALEQRDFEKVIGWNYHPEMLPNIATVAEEAGVPFEAVDLEGMREADVIVSITSAFAPSLLADHVSEGTHVACMGTDTKGKQEVEARLLAKATVFTDEVAQSISIGEAQHAVAEGLIRAEDVAELGAVINGTHPGRSSDDQITLFDGTGVGLQDLAVAASVVDLAVEKGVAIEVDF

SEQ ID NO: 175 - protein, 331 aa, Litoreibacter janthinus DSM 26921
MGGMQTDAHKLTIVPEGMIADLLTRQAAFDAVEKVFASMASGEARNFPVVRAALGHEDALYGFKGGFDRAGGVLGLKAGGYWPHNLERRGLINHQSTVLLFDPDSGRVNAMVGGNLLTALRTAAASSVSIKHLARDDAKTLGMIGAGHQSAFQLRAALEIRDFEKVIGWNLHPDKLGSLAQVAKSMGVPFEAVPLERMTEADVIISITSSFNAVLMADHVSPGTHVACMGTDTIGKQEVEVALLAKASVFTDEVAQSVSIGEAQHAISMGLITETDVKQIGAVISGSHVGRQSDDEITLFDGTGVGLQDLAVADSIVKAAVAQGLATVVQL

SEQ ID NO: 176 - protein, 327 aa, Paracoccus sp. 361
MQTQSPLLIVPEHLIADLISAQDCFAAVEQVFAAMARDTAYNFPVIREAIGHADALYGFKSGFDRESLALGLKSGGFWPRNADRGLTNHQSTIFLFDADTGRCRAVVGGNLLTALRTAAASAVSIRHLARWDARVLGMIGAGHQSIFQLRAALDQRDFDRVVGWNLNPADLDRLAKVADERGIPFQAVDLDQLGAQADVIITITSSFAPILQAAQVRPGTHLACMGTDTKGKQEVEAALLGKASVFTDEVAQSVTIGEAQHAVAQGLIAPHDIIQIGAVINGDRPGRVSDDQITLFDGTGVGLQDLAVASAAVDLAVERGIAIAVQI

SEQ ID NO: 177 - protein, 321 aa, Paracoccus homiensis DSM 17862
MLIVPEREIANLMTRQAAFEAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARPDARVLGMVGAGHQATFQLRAALEQRSFDKVIGWNYHPEMLPNIQKVADEAGVPFETVELNGMRQADVIISITSAFAPSLMADHVAPGCHVACMGTDTKGKQEVEAALLARATVFTDEVAQSVQIGEAQHAVAQGLIAESDVTQIGAVINGTHPGRDSDDQITLFDGTGVGLQDLAVAASVVDLAVQQGIAITVDF

SEQ ID NO: 178 - protein, 330 aa, Ponticoccus sp. UMTAT08
MKDMPETQGLVIVGEAECERLVGRKDAFDAVEAVFGAMAKGDAWNFPVVREAIGYADALYGFKSGFDKAGKVLGVKSGGYWPGNMDKGLTNHQSTVFLFDPDTGQLAALVGGNYLTAVRTAASSAVSIAHLARKDAKVLGMVGAGHQSQFQLRAAAEQRDFEKVVAWNPHPEMLPKLGAVAEELGLPFEAVTQEQLGAQADVIITITSAFEPLLMKDWIKPGTHIACMGTDTKGKQEVDAALVAATTVFTDEVAQSISIGEAQHAIAEGSLTEDRITPIGAVINGAHPGRSSDDEITLFDGTGVGLQDLAVASVAARLAEEEGSAKRVSL

SEQ ID NO: 179 - protein, 334 aa, Marinobacter psychrophilus 20041
MDTSSEALTQPHQILIVSEDACQKVIGRHEAFQAVESVFSSMAKGSAYNFPVVREAIGHANALYGFKSGFDREGLVLGVKAGGYWPGNVVQGRTNHQSIVALFDPDTGQLKALVSGNYLTAIRTAASSAVSIAHLARKNAKVLGMIGAGFQSTFQLHAALEQRDFEKVVAWNTHPEHLTRLADVCREHNLPFEAVSLQALGSQSDVIITITSASEPLLQAAWVKPGTHLACMGTDTKGKQEIDHRILAQATVFTDEIDQSISIGEAQHAVTARILSAEQITPIGEVINGLHQGRQSEQEITLFDGTGVGLQDLAVASAAASLAEVRGLAQRVTL

SEQ ID NO: 180 - protein, 321 aa, Methylobacterium sp. Leaf361
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFERVLAWNLHPGMFGRMEAVAREHGVPFEAVDLDRLGAEADVVVTITSSFAPILKAAQVRPGTHLACMGTDTRGKQEVEAELLAGATVFTDEVAQSVSIGEAQHAVTRGLLAADSIVEIGAVINGDHPGRVSESEITLFDGTGVGLQDLAVAAVAVDRAVAKGLATEVDV

SEQ ID NO: 181 - protein, 332 aa, Aestuariivita boseongensis BS-B2
MGLDGAMTDSAVTIVPEGEIAGLITPQIAFDAVEATFAAMSRKSAYNFPVIRESIGHADALYGFKSGFDRDSLALGLKSGGYWPGNEAKGLTNHQSTVILFDADTGKVKALVGGNLLTALRTAAASAVSIKHLAREDAKVLGMIGAGHQSAFQMRAAVAQRNFEKVVGWNYHPEMLSRLEDTATELGLPFEAVSLEELGAQSDVIISITSSFAPSLLDAHVKPGTHIAAMGTDTKGKQEIDAPILARATVFTDEIAQSITIGEAQHAIADGSLTEGQITEIGAVINGDHAGRTSADEITVFDGTGVGLQDLAVARVAVDLAQAKGVASKVDF

SEQ ID NO: 182 - protein, 321 aa, Paracoccus isoporae DSM 22220
MLIVPEREIADLMTRSAAFDAVEKVFAAMASGDAYNFPVIREAIGHADALYGFKGGFDRAGLTLGLKAGGYWPNNLDQHGIINHQSTVFLFDPDTGRVRAMVGGNLLTALRTAAASSVSIRHLARDDAKVIGMIGAGHQAKFQLRAALEQRDFEKVIGWNLHPEMLPNLEEVAAEAGLPFEAVELDGIREADVIISITSSFDAILMADQVSPGTHIACMGTDTKGKQEVDPALLARATVFTDEVAQSVSIGEAQHAVAAGLIAESDITQIGAVINGTHPGRASAEEITLFDGTGVGLQDLAVAAAVVDLAVQNGVAVEVDF

SEQ ID NO: 183 - protein, 321 aa, Aminobacter aminovorans KCTC 2477
MIIIPERDIAGLVSAADCFVAVEQTFASMAKQSARNFPVIREALGHADALYGFKSGFDRESLALGLKSGGYWPNNAQKGLTNHQSTVFLFDADTGRCRAIVGGNLLTALRTAAASAVSIKHLARPDSKVLGIVGAGHQSTFQLRAALEQRPFEKVLAWNKTPEKLERLASVAREKGLPFQSVSLEQLCGEADVVITITSSFSPVIAEGLIRPGTHLACMGTDTKGKQEVAPEIVAGSTVFTDEVVQSTSIGEAQHAFRLGMIDAAAIIPIGVVVNGDHPGRRSAEEITLFDGTGVGLQDLAVASAAVDLALARGTAIEVDA

SEQ ID NO: 184 - protein, 321 aa, Aminobacter aminovorans KCTC 2477
MIIVPEREIAWLVSDADCFAAVERVFASMAKKSASNLPVVREAIGHLDAIYGVKSGIDREGLVLGLKSGGFWPNNVSRGLTNHQSTIMLFNADTGECRAVVGANLLTALRTAAASAISIKYLSRPDSKVLGIIGAGHQSTFQLKAALQQRAFEKVVGWNIVPQHLARLETVAAEHGLPFERVDLDTLGAQADVIITITSSFDPILRAGQVRPGTHLACMGTDTKGKQEVDARLLANATVFTDEVAQAVTMGETQHAVAEGLVDASAIIAIGAVINGDHSGRVSAEEITLFDGTGVALQDLAVASVAVERAVATGVATTIAF

SEQ ID NO: 185 - protein, 321 aa, Loktanella litorea DSM 29433
MIIVPEREIADLMTRAAAFDAVEKVFAAMAADDAYNFPVVREAIGHEDALYGFKGGFDRAGKVLGLKAGGYWPHNLEKRGEINHQSTVFLFDPDTGKAKAMIGGNLLTALRTAAASSVSIKHLAREDAKVMGMIGAGHQATFQLRAALEQRSFEKVIGWNYHPDMLPNIAKIAEEAGLPFEAVDLPGMAEADVIISITSAFAPSLMADHVSAGTHIACMGTDTKGKQEVEAALLAKATVFTDEVAQSVSIGEAQHAVAEGLIAESDVHQLGAVINGTHPGRVSADDITLFDGTGVGLQDLAVAASVVDLAIEKGIAIEVDF

SEQ ID NO: 186 - protein, 332 aa, Marinobacterium lutimaris DSM 22012
MTTPASGAGNPISIVSEAVCQQIVGRPEAFKAVENVFAAMARGDAYNFPVVREAIGHADALYGFKSGFDRAGMALGVKSGGYWPGNVQKDLTNHQSTVILFDPDTGQLKSLVGGNYLTAVRTAAASAVSIAHLARKDAKVLGMIGAGHQSTFQLRAALEQRDFEKVVAWNPHPEHLPRLAAVCEELRVPFEAVTQQELGAQADVIITITSAFEPLLLKEWIKPGTHIACMGTDTKGKQEVDPALLAAASVFTDEVAQSVLLGEAQHAVASGLIAESDITPIGEVINGTHVGRRDDQEITLFDGTGVGLQDLAVASAAAELADQKGLSQTIVL

SEQ ID NO: 187 - protein, 330 aa, Rubrimonas cliftonensis DSM 15345
MKDAADAAAIAIVSEDVCKEVVSRADAFEAVEKVFAAMARGDAYNFPVIREAIGHADALYGFKSGFDRAGLVLGLKSGGYWPGNAARGLTNHQSTVFLFDPDTGRLRALVGGNHLTALRTAAASAVSIAHLARRDAKVLGMVGAGHQAQFQLRAAAEQRRFERVVAWNYHPDMLPKLGAVAAEIGLPFEAVERERLCAEADVIITIGSSTEPQIMADWVKPGTHLACMGTDTRGKQEVDPALLARATVFTDEVAQSITIGEAQHAVAQGLIGEDAVTPLGRVINGDHPGRTGDDEITLFDGTGVGLQDLAAAAVAMARAVESGKAQTLTL

SEQ ID NO: 188 - protein, 321 aa, Planktotalea frisia SH6-1 (PFRI); identical to SEQ ID NO: 96

SEQ ID NO: 189 - protein, 321 aa, Aureimonas altamirensis ON-56566
LIIVPERDIAGLIGPADCLAAVEGVFAAMARGTARNFPVVREALGHADALYGFKSGFDAESLALGLKSGGFWPGNMARGLTNHQSTIFLFDADTGQCRAIVGGNRLTALRTAAASAISIKYLAREDARVLGIIGAGHQSTFQLEAALEQRAFEKIVGWNVEPDMLSKLEEVAARRGLPFERVDLDGLGAQADVIITITSSFAPILKAAQVRPGTHIACMGTDTVGKQEVEAELVSRASVFTDEVAQAVTLGESQHAVAAGLVDAGSIVEIGQVVTGAHPGRTSAEEITLFDGTGVGPQDLAVASAVVDLAVRKGIATEVEF

SEQ ID NO: 190 - protein, 334 aa, Marinobacter sp. Hb8
METSSKEPSQPHQILIVNEDACREVIGRHEAFQAVEAVFASMARGGAYNFPVVREAIGHADALYGFKSGFDREALVLGVKSGGYWPGNAARGLTNHQSTVVLFDPDTGRLKALVGGNYLTAVRTAASSAVSIAHLARKDAKVLGMVGAGYQSTFQLKAALEQRAFEKVVAWNAHPEHLTRLAAICEEKGIPFEGVSRQELGAQSDVIITITSAFEPLLDADWIKPGTHLACMGTDTKGKQEVDHKLLAQATVFTDEIAQSISIGEAQHAVAAQILSEDQITPIGEVINGTNPGRQSEADITLFDGTGVGLQDLAVASEAARLAETGGLAQRVTL

SEQ ID NO: 191 - protein, 329 aa, Ruegeria sp. ZGT108
MKDMSDNGLLIVSEDLCQQLVGRKEAFDAVQDVFAAMARGDAYNFPVIREAIGYADALYGFKSGFDRAGQVLGVKSGGYWPGNTEKGLTNHQSTVFLFDPDTGRLSALVGGNYLTAVRTAASAAVSIAHLARRDSKVLGMVGAGHQSTFQLRAAAEHRDFEKVVAWNPHPEMLPRLEGVAHEVGLEFQAVTQEELGAQADVIITITSAFEPLLMKDWIKPGTHLACMGTDTKGKQEVDAMLVAHATVFTDEVAQSITIGETQHAVADGQLTKDQITPIGAVINGDHPGRGSDEEITLFDGTGVGLQDLAVASVAAKLADKAGLAGRATL

SEQ ID NO: 192 - protein, 320 aa, Paracoccus sediminis DSM 26170
MWVVPEHEIAGLMTPEAAFDAVEAVFAAMARGDARNFPVVREALGHEDALYGFKGGFDGAGMTLGLKAGGYWPNNQKHGLINHQSTVFLFDPDTGRVSAAVGGNLLTALRTAAASAVSSKYLAPEGARVLGMIGAGHQSAFQMRAAVRFGQFEKVVGWNPHPAMLSRLADTAAELGLPFEAVDLPQLGADADVIITITSAFEPLLLDGHVTGPTHIAAMGTDTKGKQELDPALVARARLFTDEVAQSVSIGEFQHASAQKTVSADDITALGQVIIGNHPGRGDAQVTIFDGTGVGLQDLAVASAVVELAKQHGKAIQVAI

SEQ ID NO: 193 - protein, 321 aa, Ruegeria scottomollicae DSM 25328
MYIVPERAIADLMTRKAAFDAVEQVFAAMAAGDAYNFPVVREAIGHEDALYGFKGGFDRAGLTLGLKAGGYWPNNLEKRGLINHQSTVFLFDPDTGKVRAMVGGNLLTALRTAAASSVSIKHLAREDAKVIGMIGAGHQAKFQLRAALEQREFDKVIGWNLHPEMLANLEEVATEAGLPFEAVELDGLKEADVIISITSSFDAILKADQVSPGTHIACMGTDTKGKQEVDPELLVRADVFTDEVAQSISIGEAQHAVAQGLIAEADVAQLGAVINGAHPGRTSAEQITLFDGTGVGLQDLAVASSVVELAVKQGIAIEVDF

SEQ ID NO: 194 - protein, 321 aa, Rhizobium leguminosarum CGMCC 1.2553T
MIIVPESAVRDLVSLEDCVNAVEKAFVSMAERSAQNFPVVREAIGYEDALFGFKSGFNREGLALGLKAGGFWPNNASKGLTNHQSTVFLFDPETGRCRAVVGGNLLTALRTAAASAVSIKYLARKDAKVLGMVGAGHQASFQLRAAVQQRAFEKVVAWNFHPEMLPKLAAVADELAIPFEAVELDRLGDEADVIITITSSFQPILKAQQVRPGTHLACMGTDTKGKQEVDAALFASATLFTDEIAQAISIGESQHAIAQGLVAPVDIGEIGAVISGRIPGRSSADQVTLFDGTGVGLQDLAVAQAAVELAIARGTAVEIEI

SEQ ID NO: 195 - protein, 321 aa, Sulfitobacter sp. HI0021
MLIVPEREIANLMTREAAFDAIEKVFAAMASGDAYNFPVVREAIGHEDALYGFKGGFDRAGLSLGLKAGGYWPNNLEKRNLINHQSTVFLFDPDTGKVKAMVGGNLLTALRTAAASSVSIKHLARKNATVIGMVGAGHQATFQLRAALEQRKFEKVIGWNYHPEMLPNIEKVAHEAGVPFEAVDLPGMTEADVIISITSAFSPSLMADHVSPGTHIACMGTDTKGKQEVEAALLARASVFTDEVAQSVSIGEAQHAIAEGLIKDTDVAQLGAVINGTNPGRTSDHQITLFDGTGVGLQDLAVAAKVVDLAVEQGVAIDVDF

SEQ ID NO: 196 - protein, 321 aa, Sulfitobacter sp. HI0076; identical to SEQ ID NO: 195

SEQ ID NO: 197 - protein, 321 aa, Thalassobius mediterraneus CECT 5118; identical to SEQ ID NO: 34

SEQ ID NO: 198 - protein, 332 aa, uncultured Rhodobacteriaceae sp. PT6CLA
MNDMTQAQTDGLIIVSEEICQQVIGRQDAFDAVEAVFGAMAKGDAYNFPVIREAIGHADALYGFKSGFDRAGLALGLKSGGYWPGNADKGLTNHQSTVFLFDPDTGKLKALVGGNYLTALRTAAASSVSIAHLARKDAKVLGMVGAGHQSAFQLRAAAEQRDFEKVVAWNPHPEMLPKLGEVATQIGLEFEAVERDQLGAEADVIITITSAFEPLMMASQIKPGTHIACMGTDTVGKQEVDPALLAAATVFTDEVAQSISLGEAQHAIAQGLIAEADITPIGNVINGTHPGRSSADEITLFDGTGVGLQDLAVASVAADLAAKAGTATRVAL

SEQ ID NO: 199 - protein, 321 aa, Sinorhizobium terangae WSM1721
MIIVPENQIAGLITPADCLAAVEGVFASMAKRSAYNFPVIREAIGHADALYGFKSGFDRDSLALGLKSGGFWPNNVQKGLANHQSTVFLFDADTGRCRAVVGGNLLTALRTAAASAVSIKYLARRDAKVLGMIGAGHQSTYQLRAAVEQRPFEKVLAWNLHPEMLSRLEGVARELELPFETVDLDRLGDEADVIISITSSFAPILKASQVRPGTHLACMGTDTKGKQEMDAELLAAATVFTDEVAQAVTIGECQHAIEKGLISRDDIVEIGAVITGRHTGRSSPEEITLFDGTGVGLQDLAVASAAVELALSKGTAIEVDF

SEQ ID NO: 200 - protein, 321 aa, Ruegeria sp. TW15; identical to SEQ ID NO: 117

SEQ ID NO: 201 - protein, 321 aa, Rhizobium sp. BR816
MIIVPENQIAGLITPADCLLAVEGVFASMAERSAYNFPVIREAIGHADALYGFKSGFDRDSLALGLKSGGFWPNNVEKGLANHQSTVFLFDADTGGCRAVVGGNLLTALRTAAASAVSIKYLARNDAKVLGMIGAGHQSTYQLRAAVEQRPFEKVLAWNLHPEMLSRLERIARELELPFETVDLDRLGAESDVIISITSSFAPILKASQVRPGTHLACMGTDTKGKQEVDPELVAAATVFTDEVGQAVTIGECQHAIDKGLISKDDIVEIGAVITGRHKGRSSSEEITLFDGTGVGLQDLAVASAAVELALSKGAAIEVDF

SEQ ID NO: 202 - protein, 334 aa, Glaciecola sp. ANT9081 (cola82)
MIIQNDEMNTDKGITIISEAICEAVVGRPEAFTAVENVFAAMAKGDAYNFPVVREAIGHADALYGFKSGFDRAGMALGVKSGGYWPGNAKKNLTNHQSTIFLFDPDTGQLISLVGGNHLTAMRTAASSAVSIAHLARKDAKVLGMVGAGHQSTFQLRAALEQRKFEKVVAWNLHSADLQRLAKVCEELGLPFEALERKELGAQADVIITITSAFEPLMMKEWIKPGTHIACMGTDTKGKQEVDPELLVAATVFTDEIAQSVSIGEAQHAIASGTIKAEDIVPIGEVINGTHPGRLSDEEITLFDGTGVGLQDLAVAQAAAVLAEKQGLAVSINL

SEQ ID NO: 203 - protein, 321 aa, Paracoccus pantotrophus J40
MWIVPEKEIAGLMTPEAAFDAVQAVFAAMASGKASNFPVVREAIGHEDALYGFKGGFDRSARNLGLKAGGYWPNNQRRELINHQSTVFLFDADTGRVQAAVGGNLLTALRTAAASAVSIKYLARPDAKVLGIVGAGHQSTYQLRAALDQRPFEKVLAWNRTPERLKRLEAAAQEKGLPFKSVTLEQLCRQADVVVTITSSFSPMIAEGLIRPGTHLACMGTDTRGKQEVAPEIVAASTVFTDEVAQSTTIGEAQHAFGMGLLDAAAIVPIGDVINKEHPGRRSAEEITLFDGTGVGIQDLAVASAAVDLAVARGRAVEVEM

SEQ ID NO: 204 - protein, 320 aa, Paracoccus pantotrophus J40; identical to SEQ ID NO: 45

SEQ ID NO: 205 - protein, 321 aa, Marinovum algicola DG 898
MFIVPERDIADLMTREAAFDAVEKVFAAMASGDAYNFPVVREAIGHEDALYGFKGGFDRAGLTLGLKAGGYWPNNLEKRGIINHQSTVFLFDPDTGKAKAMVGGNLLTALRTAAASSVSIKHLARKDAKVIGMVGAGHQAKFQLRAALEQREFEKVIGWNFHPEMLPNLEEVASEAGLPFEAVALEGLTEADVIISITSSFDAILHADHVAPGTHIACMGTDTKGKQEVETALLGKATVFTDEVAQSISIGEAQHAIESQILRAEDITQVGAVINGTHPGRTSDEEITLFDGTGVGLQDLAVAAAVVDLAVAKGLAIEVDF

SEQ ID NO: 206 - protein, 321 aa, Labrenzia alexandrii DFL-11
MIIVPEKEIAALLGRAEAFEAVESVFAAMSSGVAYNFPVIREAIGHADALYGFKSGFDRSSLALGLKSGGYWPGNADKGLTNHQSTVFLFDADTGKAKAVVGGNLLTALRTAAASAVSIKHLARKHAKVLGMIGAGHQSAFQMRAAVEQRSFEKVIGWNLHPEMLSRLEETAAELDLPFEAVDLDRLGAEADVIISITSSFDPILKVSQVTPGTHLACMGTDTKGKQEVEAELVAKATVFTDQVAQSSTIGECQYAVASGLISESDINEIGAVINGNHKGRTSVDEITLFDGTGVGLQDLAVASKVVDLAVEKGIAISVDF

SEQ ID NO: 207 - protein, 321 aa, Methylobacterium sp. 285MFTsu5.1
MIIISEREIATLVSPADCFAAVEGVFASMAKGKAYNFPVVREAIGHADALYGFKSGFDRESLALGLKSGGFWPGNVEKGLTNHQSTIFLFDADTGCCRAIVGGNLLTALRTAASSALSIKYLARPEARVIGMIGAGHQSTFQLSAALDQRRFEKVVGWNIEPSALGRLESVAVERGIPFEAVDLDRLGAEADVIITITSSFAPILKAAQVRPGTHLACMGTDTKGKQEVEAELLAKASVFTDEIAQATSIGEAQHAVAQGLLAATDIVAIGSVINGAHPGRRSPEDITLFDGTGVGLQDLAVASTAVDLAIARGVAREIDF

SEQ ID NO: 208 - protein, 321 aa, Methylobacterium sp. 285MFTsu5.1
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFERVLAWNLHPGMFGRMEAVAREHGVAFEAVDLDRLGSEADVVVTITSSFAPILKAAQVRPGTHLACMGTDTRGKQEVEAELLAAATVCTDEVAQSVSIGEAQHAVARGLLAADSIVEIGAVINGDHPGRVSESEITLFDGTGVGLQDLAVAAVAVDRAVAKGLATEVDV

SEQ ID NO: 209 - protein, 321 aa, Methylobacterium sp. EUR3 AL-11
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCKAVVGGNLLTALRTAAACAISVRHLARKDARVLGMIGAGHQSAFQLRAALAQRPFERVLAWNLHPGMFGRMEAVARERGVPFEVVDLDRLGAEADVVVTITSSFAPILKAAQVRPGTHVACMGTDTRGKQEVEAELLAAATVFTDEVAQSVSLGEAQHAVARGLLAADSIVEIGAVINGDHPGRVSDAEITVFDGTGVGLQDLAVAAVAVDRAVAKGLATEVDF

SEQ ID NO: 210 - protein, 320 aa, Paracoccus yeei ATCC BAA-599
MLVVAEKEIGGLMTPEAAFEAIEAVFAAMDAGKAYNFPVVREAIGHEDALYGFKGGFDASALTLGLKAGGYWPNNQKHDLINHQSTIFLFDADTGRVAAAVGGNLLTALRTAAASAVSIKYLAPKGARVLGMIGAGHQSAFQMRAAARVHAFEKVIGWNPHPEMLTRLAETAAELGLPFEAVDLDRLGAEADVIVSITSSFSPLLMNEHVRGETHIAAMGTDTKGKQELDPALVARAKLYTDEVAQAVSIGECQHAVAQGLVEAAAITRLGAAVNGTDPGRDGAEITLFDGTGVGLQDLAVAAKVVQLAQAKGIAQTVEI

SEQ ID NO: 211 - protein, 321 aa, Defluviimonas sp. 20V17; identical to SEQ ID NO: 27

SEQ ID NO: 212 - protein, 321 aa, Sphingomonas sp. DC-6
MIIVPEREIAGLISASDCFTAVEQVFASMAKKSAYNFPVIREAIGHADALYGFKSGFDRESLALGLKSGGFWPNNMAKGLTNHQSTVFLFDADTGKCKAVVGGNLLTALRTAAASAVSIKYLARPDSKVLGMIGAGHQSTFQLRAALEQRPFEKVIGWNLHREALSRLEAVAAEKGLPFEAVDLDRLGAEADVIITITSSFDPILEAAQVRPGAHLACMGTDTKGKQEVDAELVAASTVFTDEIAQSITIGEAQHAVAEGLIAAESIIEIGAVINGSHPGRTSEREITLFDGTGVGLQDLAVASAAADLAVSKGVAIEVDF

SEQ ID NO: 213 - protein, 332 aa, AP Rhodobacteraceae bacterium bin18
MADGASAPANELVIVPEGMIPDILTREASFDAVEKVFAAMAAGEARNFPVVREAIGHEDALYGFKGGFDAVGGVLGLKAGGYWPHNLDRRGIINHQSTVFLFDPDTGRVKALVGGNYLTALRTAAASSVSIRHLARKDAKVLGMIGAGHQAKFQLRAAAETHAFEKVIGWNLHPEMLPGLAEVAREVGLPFEAVELPGMSEADVIITITSSFAPTLLADHVSPGTHLACMGTDTKGKQEVEAALLGRARVFCDEVAQSVSIGEAQHAVAEGLLSEGDVTQLGAVINGTHGGRGSDEEITLFDGTGVGLQDLAVADAIVKTAVAQGIATIVPL

SEQ ID NO: 214 - protein, 320 aa, Paracoccus sulfuroxidans CGMCC 1.5364
MYVVPEKEIAGLMTPDAAFEAIEAVFASMARRKAYNFPVVREAIGYEDALYGFKGGFDAAGLSLGLKAGGYWPNNQKHNLINHQSTVFLFDPDTGRVSAAVGGNLLTALRTAAASAVSIKYLAPKGAKVLGMIGAGHQSAFQMRAAARVHNFEKVIGWNPHPEMLTRLADTAAELGLPFEAVELDRLGSEADVIISITSAFSPLLMDSHVKGPTHIAAMGTDTKGKQELDAALVARARVFTDEVAQSISIGEAQHAIAQGLIAEEAINELGAVVTGDHEGRGDAEVTIFDGTGVGLQDLAVAHKSVEIAKQKGVALTVEI

SEQ ID NO: 215 - protein, 330 aa, Marinobacterium sp. AK27
MSTSVNGAGVAIVSEAVCEQIVGRPEAFKAVESVFGAMARGDAYNFPVVREAIGHADALYGFKSGFDRAGMVLGVKSGGYWPGNVQKDLTNHQSTVILFDPDTGRLKALVGGNYLTAVRTAAASAVSIAYLARKDAKVLGMVGAGHQSTFQLRAALEQRAFEKVVAWNPHPEYLSRLAAVCDELRVPFEAVDQQQLGAQADVIITITSAFEPLMMKEWIKPGTHIACMGTDTKGKQEVDPELLAAATLFTDEVAQSISIGEAQHAVASGLISESDITPIGEVINGTHPGRRDDQEITLFDGTGVGLQDLAVASAAANLALEQGLALRIAL

SEQ ID NO: 216 - protein, 321 aa, Yangia pacifica DSM 26894
MLIVPEREIADLMTREAAFAAVEKVFAAMAAGDAYNFPVVREAIGHEDALYGFKGGFDRSGLTLGLKAGGYWPNNLEKRGIINHQSTVFLFDPDTGKARAMVGGNLLTALRTAAASSVSIRHLAREDARVIGMVGAGHQATFQLRAALEQRDFDKVIGWNLHPEMLPNLEKVAAEAGVPFEAVELTGMREADVIISITSSFDAILMAEHVSPGCHIACMGTDTKGKQEVSPALLAKATVFTDEVAQSVSIGEAQHAVAQGLIDESAITQLGAVINGAHPGRRSAEEITLFDGTGVGLQDLAVAAAVVDLAVEKGIAIEVDF

SEQ ID NO: 217 - protein, 321 aa, Shimia haliotis DSM 28453
MLIVPEREIADLMTRDAAFDAVEKVFAAMASGDAYNFPVVREAIGHEDALYGFKGGFDQAGLTLGLKAGGYWPNNLEKRGLINHQSTVFLFDPDTGKAKAMVGGNLLTALRTAAASSVSIKHLARSDSKVIGMVGAGHQATFQLRAALEQRNFEKVIGWNYHPEMLPNIEKVANEAGLPFEAVDLPGLTEADVIISITSAFAPSVMAEHISEGTHIACMGTDTKGKQEVEAALLVKADVFTDEVAQSISIGEAQHAVAQGLIKETDVAQLGAVINGTIAGRTSDDQITLFDGTGVGLQDLAVAASVVDLAVEKGIAIEVDF

SEQ ID NO: 218 - protein, 322 aa, Hasllibacter halocynthiae DSM 29318
MIIVPEAAIADLVDRAAAFDAVEATFAAMASGDARNFPVVREALPGPEEALYGFKGGVDASAEALGLKAGGYWPHNLERRGLINHQSTVFLFDPETGRPTAMVGGNLLTALRTAAASSVSIRHLAREDARVIGMVGAGHQAGFQLRAALEQRPFEKVIGWNLHPEMLPNLEKVAAEAGLPFEAVELEGLRAADVIVTITSSFAPTLMAGHVGPGAHVACMGTDTVGKQEVDPELLKLATVFADEVAQSVTLGEAQHAVGAGTIAEGDLTPIGDVIRGVHPGRTSQEEITLFDGTGVGLQDLAVAAAAVRLAQEKGVAVEVEI

SEQ ID NO: 219 - protein, 321 aa, Oceanicola nitratireducens DSM 29619; identical to SEQ ID NO: 104

SEQ ID NO: 220 - protein, 321 aa, Ruegeria halocynthiae DSM 27839
MIIVPEKEIGALLGRKESYEAIEQVFAAMASGNAYNFPVVREAIGHADALYGFKGGFDQAGMTLGLKAGGYWPNNLETHGLINHQSTVFLFDPDTGRVKAVVGGNLLTALRTAAASSVSINYLARKDAKVIGMVGAGHQAKFQLRAALEQRNFEKVIGWNLHPEMLPNLEEVAAEAGLPFEAVELSGMTEADVIITITSSFAPTLMSDHVSDGTHIACMGTDTIGKQEVGVDLIARASVFADEIAQSITLGECQHAIANGSKAEADIRQVGEVINSTHQGRTSDDEVTLFDGTGVGLQDLAVASAVVDLAVEQGIAIKVDF

SEQ ID NO: 221 - protein, 334 aa, Citreimonas salinaria DSM 26880
MNAPDKTATAANMVTIVPESEIGGLMDAASAFDAVEATFAAMARGDAYNFPVIREAIGHADALYGFKSGFDKAALALGLKSGGYWPGNEARGLTNHQSTVILFDADTGRVKALVGGNLLTALRTAAASAVSIAHLSRKDSKVLGMVGAGHQSAFQMRAACAQRDFDKVVGWNYHPEMLSRLEDTAKELGLPFEAVEREDLCAQADVIITITSSHDAQLMADWVKPGTHVACMGTDTKGKQEVDPALLARASVFTDEVAQSVTLGEAQHAVAQGLIKEADITPIGAVIEGTAKGRTSDDQVTLFDGTGVGLQDLAVAAKVVDLALKAGKAQQVPF

SEQ ID NO: 222 - protein, 321 aa, Ruegeria mobilis S1942
MYIVPERAIADLMTRDAAFDAVEKIFAAMAAGDAYNFPVVREAIGHEDALYGFKGGFDSAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLPNLKEVATEAGLPFEAVELDGLKEADVIISITSSFDAILKADQVSPGTHIACMGTDTKGKQEVDPQLLVRATVFTDEVAQSISIGEAQHAVAQGLITEADVAQLGAVINGAHPGRSSAEQITLFDGTGVGLQDLAVAASVVELAVKKGVAIEVDF

SEQ ID NO: 223 - protein, 321 aa, Leisingera aquaemixtae CECT 8399
MYIVPEKAVADLVTREASFDAVEKVFAAMASGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQAKFQLRAALEQRNFEKVIGWNFHPDMLPNIEKVAAEAGVPFEAVDLPGMRDADVIISITSAFAPSLMADHVSPGTHVACMGTDTKGKQEVEAALLVKSTVFTDEVAQSITIGEAQHAVAQGLIQESDVAQLGAVINGTNPGRTSDDQITLFDGTGVGLQDLAVAASVVEVAVEKGIAIEVDF

SEQ ID NO: 224 - protein, 321 aa, Leisingera aquaemixtae CECT 8399; identical to SEQ ID NO: 223

SEQ ID NO: 225 - protein, 320 aa, Paracoccus halophilus JCM 14014; identical to SEQ ID NO: 98

SEQ ID NO: 226 - protein, 321 aa, Ruegeria sp. ZGT118
MLIVPEREIADLMTREAAFDAVEQVFASMASGDAYNFPVVREAIGHEDALYGFKGGFDRAGLTLGLKAGGYWPNNLEKHGLINHQSTVFLFDPDTGRPTAMVGGNLLTALRTAAASSVSIKHLARTDAKILGMIGAGHQAAFQLRAALEQRNFEKVIGWNYHPEMLPNIEKVAAEAGIPFEAVPLDGMRQADVIISITSAFAPSLMADHVSAGTHVACMGTDTKGKQEVESALLAGAGVFTDEVAQSVTIGEAQHAVAEGLIKESDVAQLGAVINGTHPGRSSDDQITLFDGTGVGLQDLAVAASVVELAVRKGIAIEVDF

SEQ ID NO: 227 - protein, 326 aa, Ruegeria faecimaris DSM 28009
MKSDGLLIVGEDLCEKLVGRQQAFDAVQAVFGAMAKGGAWNFPVIREALGHADVLYGFKSGFDRDGQVLGLKSGGYWPGNAAKGLTNHQSTVFLFDPDTGRLSALVGGNYLTAVRTAASSAVSIAHLARQDARVLGMVGAGHQSTFQLRAAAEQRDFEKVIAWNPHPDMLPRLAAVATEVGLEFEAVSQQELGAQADVIITITSAFEPLLMKDWIKPGTHLACMGTDTKGKQEVDADLVAAATVFTDEVAQSVTIGEAQHAINLGALTEDAIAPIGAVINGDHPGRTSDDQITLFDGTGVGLQDLAVASVAARLAEEADLAQRATL

SEQ ID NO: 228 - protein, 321 aa, Shimia sagamensis DSM 29734
MLIVPEREIADLMTREAAFDAVEKVFAAMAARDAYNFPVVREAIGHEDALYGFKGGFDQAGLTLGLKAGGYWPNNLEKRDLINHQSTVFLFDPDTGKAKAMVGGNLLTALRTAAASSVSIKHLARDDAKVIGMIGAGHQATFQLRAALEQRQFEKVIGWNYHPEMLPNIEKVATEAGLPFEAVKLDGMKEADVIISITSAFAPSLMADHVAPGTHIACMGTDTKGKQEVESALLAKASVFTDEVAQSISIGEAQHAVAEGLIKESDVGEIGAVINGTNPGRTSADQITLFDGTGVGLQDLAVAAAVVDLAVEKGIAIEVDF

SEQ ID NO: 229 - protein, 321 aa, Sulfitobacter sp. HI0027; identical to SEQ ID NO: 195

SEQ ID NO: 230 - protein, 333 aa, Psychrobacter cryohalolentis K5
MSEANSVNSDEGLLIVSEDACKSVIDRPSAFIAVENVFASMSRGDAYNFPVIREAIGYADALYGFKSGFDRAGKSLGLKSGGYWPGNAAKGLTNHQSTIFLFNPDNGKLRALVGGNYLTAVRTAAASAVSIAHLARKDSKVLGMVGAGHQSTFQLRAALEQRNFEKVVAWNKNKDRLKNLQAVAEELGVPFEAVEREQLCSEADVIITITSAFEPLLMKEWIKPGTHIACMGTDTVGKQEVDVNLIAAATVFTDEITQSISLGETQHAIKSGAIKESDITTLGDVINGEHPGRSSDDEITLFDGTGVGLQDLAVASAATKLALEKGEAQHISL

SEQ ID NO: 231 - protein, 321 aa, Rhodobacterales bacterium Y4I scf_1106129324775 genomic scaffold
MYIVPEKAVADLVTREASFDAVEKVFAAMASGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQATFQLRAALEQRPFEKVIGWNYHPEMLPNIEKVAAEAGVPFEAVDLPGMADADVIISITSAFAPSLMADHVSPGTHIACMGTDTKGKQEVEAELLVKATVFTDEVAQSISIGEAQHAVAQGLIQESDVAQIGAVINGTNPGRTSDDQITLFDGTGVGLQDLAVAASVVEVAVEKGIAIEVDF

SEQ ID NO: 232 - protein, 330 aa, Colwellia sp MT41
MSDSQINKGVSVISEEVCQQVMGRANAFTAVENVFSAMAKKTAYNFPVIREAIGHADALYGFKSGFDRDGMVLGLKSGGYWPSNMAKGLTNHQSTVILFDPDTGKLKSLVGGNYLTAVRTAASSAISIAYLARKDAKVLGMIGAGHQSTFQLRAAVEQRNFEKVVCWNLHPEHISNLAAVAEELGLPFESVTREELCAQADVIITITSAFEALIEKDWIKPGTHIACMGTDTKGKQEVDAKLLTVAKVFTDELAQSITIGEAQHAIARKLIQQSDIVPIGEVINGTKPGRTSAEDITLFDGTGVGLQDLAVASLAAELAEAKGLATYFKL

SEQ ID NO: 233 - protein, 321 aa, cNanh_4411
MIIVPEREIANLMTREAAFVAVEQVFAAMAAQDAYNFPVIREAIGHEDALYGFKGGFDRAGKTLGLKAGGYWPNNLDKHQIINHQSTVFLFDPDTGKAKAMVGGNLLTALRTAAASSVSIKHLARKDARVIGMIGAGHQATFQLRAALEQRQFEKVIGWNFHPEMLPNLEKVADEAGLPFQAVDLNGLRDADVLISITSSFEAILQADQVSPGTHIACMGTDTKGKQEVDPALLTRATVFSDEVAQSISIGEAQHAIAMELITEHDITQIGAVINGTHPGRTSDDQITLFDGTGVGLQDLAVAASVVDLAVANGVAIEVDF

SEQ ID NO: 234 - protein, 321 aa, Methylobacterium mesophilicum SR1.6/6
MIIVPEHAIDGLLTEAECFGAVEQVFASMARRRAGNFPVVREAIGHADALYGFKSGFDRDSLALGLKAGGFWPGNAAKGLTNHQSTVFLFDADTGRCKAVVGGNLLTALRTAAACAISVRHLAREDARVLGMIGAGHQSAFQLRAALAQRPFDRVLAWNLHPGMFGRMEAVAREHGVPFEAVELDRLGAEADVIVTITSSFAAILKAAQVRPGTHVACMGTDTRGKQEVEAELLAAATVFTDEVAQSVSIGEAQHAVARGLLAADSIVEIGAVINGDHPGRISESEITVFDGTGVGLQDLAVAAVAVDRAVAKGLATEVDF

SEQ ID NO: 235 - protein, 321 aa, Methylobacterium sp. B34; identical to SEQ ID NO: 208

SEQ ID NO: 236 - protein, 321 aa, Roseivivax halodurans JCM 10272
MIIVPEKDIADLMTREAAFAAVEQVFAAMASGDAYNFPVVREAIGHADALYGFKGGFDRLGGVLGLKAGGYWPHNLETHGIINHQSTVFLFDPDTGRVAAMVGGNLLTALRTAAASSVSIRHLAREDAEVLGMIGAGHQAAFQLRAALEHRSFGKVVGWNYHPEMLPNLEKVAAEAGVAFEAVDLPGMREADVIVTITSSFDATLMAEHVAPGTHVACMGTDTKGKQEVDPALLAAATVFADEIAQSVSIGEAQHAVSAGLISESDIAELGAVINGSHPGRRSDEEITLFDGTGVGLQDLAVAAAVVALARANDTAIEVEV

SEQ ID NO: 237 - protein, 338 aa, Pelagicola litoralis DSM 18290
MAAGIGCAAVAYFKELLMIIVPEHEISGLMTRQDSFDAVEKVFASMASGAAYNFPVIREAIGHADALYGFKSGFDRAGLNLGLKSGGYWPGNADKGLTNHQSTVFLFDADTGKCRAIVGGNLLTALRTAAASAVSIKYLAPKSAKVLGMIGAGHQSSFQLRAALDQRAFEKVIGWNLHPEHLSRLEDVATEAGLPFEAVELDQLGQEADTIITITSSFAPILKNAHVTGGTHIACMGTDTVGKQEVDAELVARAQVFTDEVAQSISLGECQHAMSAGLIRQEQIAQIGDVINGTHTGRTSENDITLFDGTGVGLQDLAVASAVVELAVARGVAIEVDF

SEQ ID NO: 238 - protein, 331 aa, Thalassobacter stenotrophicus DSM 16310
MDGSPMKSHEIIIVPEAEIAGLMTPEAAFDAVEAIFGAMARKDAYNFPVIREAIGHADALYGFKSGFDRAGGALGLKSGGYWPGNEAKGLTNHQSTVILFDRDTGRPKAMVGGNLLTALRTAAASAVSIKHLARADSKVLGMIGAGHQSAFQMRAALAQRPFEKVIGWNYHPEMLSRLEAVATEAGLPFEAVDLDRLGAEADVIISITSSFDAILHDAQVTAGTHVACMGTDTKGKQEVEAALVARATVFTDEIAQSTTIGEAQHAIASGLITEAAITEIGAVINGTHPGRTSAEEVTLFDGTGVGLQDLAVAEAVVDLALKTGVATRVPF

SEQ ID NO: 239 - protein, 321 aa, Methylobacterium sp. UNC300MFChir4.1
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFERVLAWNLHPGMFGRMEAVARERGVPFEAVDLDRLGAEADVVVTITSSFAPILKAAQVRPGTHVACMGTDTRGKQEVEAALLAAATVFTDEVAQSVSIGEAQHAVARGLLAADSIVEIGAVINGDHPGRVSESEITLFDGTGVGLQDLAVAAVAVDRAVAKGLATEVDV

SEQ ID NO: 240 - protein, 320 aa, Paracoccus pantotrophus DSM 1403
MLVVAEKEIAGLMTPEAAFEAIEAIFASMARRKAYNFPVVREAIGHEDALYGFKGGFDASALVLGLKAGGYWPNNQKHNLINHQSTVFLFDPDTGRATAAVGGNLLTALRTAAASAVSIKYLAPKGAKVLGMIGAGHQSAFQMRAVANVHPFEKVIGWNPHPEMLSRLADTAAELGLPFEAVELDRLGTEADVIISITSSFSPLLMDQHVKGPTHIAAMGTDTKGKQELDPALVARARIFTDEVAQSVSIGECQHAIASGLIREDQIGELGAVVAGDHPGRGDAEVTLFDGTGVGLQDLAVAQKVLEIAKEKGLAQEVEI

SEQ ID NO: 241 - protein, 321 aa, Rhizobium lusitanum P1-7; identical to SEQ ID NO: 95

SEQ ID NO: 242 - protein, 333 aa, Paracoccus alkenifer DSM 11593
MIIVPEHAIAGLVSASDCLEAVEQVFAAMARRSARNFPVIREALGHADALYGFKSGFDRESLALGLKSGGFWPGNISRGLTNHQSTVFLFDADTGACRAVVGGNLLTALRTAAASAISIKHLARPDARVLGMIGAGHQSSFQLRAALAQRHFEKVVGWNLHQPDLARLNAVATELGVPFEAVDLDRLGAEADVIITITSSFDPILMAAQVRPGTHLACMGTDTAGKQEVEPALVAAATVFTDEITQSITLGEAQHAAAQGLLAAAQITELGAVINGTHPGRTSAQEITLFDGTGVGLQDLAVASVAVDRALDKGVAITVDFQSPIGPAGATSP

SEQ ID NO: 243 - protein, 321 aa, Loktanella koreensis DSM 17925
MIIVPEKEIAGLMTREAAFDAVEAVFAAMSKGSAYNFPVIREAIGHADALYGFKSGFDRESLALGLKSGGFWPGNDAKGLTNHQSTIFLFDADTGQCRALVGGNLLTALRTAAASSVSIKHLARADAKVLGMIGAGHQSTFQMRAALEQRDFEKVIGWNYHPDMLSRLSDLADELGIPFEAVDLERMGQEADVIISITSAFAPSLMDAHISHGTHIACMGTDTKGKQEVETALLGRAKVFTDEIAQSVSIGEAQHAIAAGLLTADQITEIGSVINGDSPGRTSADDITLFDGTGVGLQDLAVASTVVDLAVAQGVAIEIEF

SEQ ID NO: 244 - protein, 321 aa, Methylobacterium sp. 190MF
MIIVSEREIATLVSPADCFAAVEGVFASMAKGKAYNFPVVREAIGHADALYGFKSGFDRESLALGLKSGGFWPGNVEKGLTNHQSTIFLFDADTGCCRAIVGGNLLTALRTAASSALSIKYLARPEARVIGMIGAGHQSTFQLSAALDQRRFEKVVGWNIEPSALGRLESVAVERGIPFEAVDLDRLGAEADVIITITSSFAPILKAAQVRPGTHLACMGTDTKGKQEVEAELLAKASVFTDEIAQATSIGEAQHAVAQGLLAATDIVAIGSVINGAHPGRRSPEDITLFDGTGVGLQDLAVASTAVDLAIARGVAREIDF

SEQ ID NO: 245 - protein, 321 aa, Methylobacterium sp. 190MF; identical to SEQ ID NO: 208

SEQ ID NO: 246 - protein, 332 aa, Ruegeria sp. ANG-S4
MRDEMNTQTDGLLIVDEDACEQLVGRQQAFDAVQDVFAAMARGDARNFPVVREALGHADAIYGFKSGFDRSGQVLGVKSGGYWPGNSQKGLTNHQSTVVLFDPDTGRITALVGGNYMTAVRTAASSAISIAHLARPDAQILGMVGAGHQSTFQLRAAAEQREFEKVVAWNPHPEMLPRLAEVAEDLGLEFEATTPEGLGAQADVIITITSAFEPLLKKDWVKPGTHLACMGTDTKGKMEVDPALVAAATLFTDEVAQSISIGEAQHAALKGEISQDAITPIGAVINGDHIGRSNDAEITLFDGTGVGLQDLAVASVAAQLAKNTGLANKVTL

SEQ ID NO: 247 - protein, 321 aa, Leisingera nanhaiensis CGMCC 1.10959; identical to SEQ ID NO: 233

SEQ ID NO: 248 - protein, 331 aa, Loktanella rosea DSM 29591
MSGRKRKTKTMIIVPEKEIAGLLTRADAFEAVEKVFASMSKGSAYNFPVIREAIGYEDALYGFKGGFDKAGMALGLKAGGYWPNNLEKHGEINHQSTVFLFDPDTGKVKAMVGGNLLTALRTAAASSVSIKHLARKDAKVMGMVGAGHQATFQLRAALEQRDFEKVIGWNYHPEMLPNIERVANEAGLPFEAVPLEGLAEADVVISITSTFAPTIMADHIAPGTHIACMGTDTKGKQEVEASLLARATVFTDEVAQSISIGEAQHAIASGLIEQSDVHELGAVINGTHPGRTSADEITLFDGTGVGLQDLAVASSIVDLAVEKGVATIVDF

SEQ ID NO: 249 - protein, 321 aa, Poseidonocella pacifica DSM 29316
MIIVPENKIGDLMTRADSFAAVEKVFASMAKGSAYNFPVIREAIGHADALYGFKSGFDRSELVLGLKSGGFWPGNMEKGLTNHQSTVFLFDADTGKCKAVVGGNLLTALRTAAASAVSIKYLAPKGAKVLGMIGAGHQSAFQMRAAAEQRDFEKVIGWNVDPAMLSRLEETAAEIGLPFEAVDLDRLGAEADTIITITSSFDAILMDAQVTGGTHIACMGTDTKGKQEVDAALVGRATVFTDEVAQSISIGEAQHAVANGVLKEADIAQIGAVINGDHPGRTSDDELTLFDGTGVGLQDLAVADAVVKRAVEAGVAVEVDF

SEQ ID NO: 250 - protein, 321 aa, Leisingera sp. ANG-S5
MYIVPEKAIADLVTREASFDAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQATFQLRAALEQRQFEKVIGWNYHPEMLPNIEKVAAEAGLPFEAVDLPGMTEADVIISITSAFAPSLMADHVSPGTHIACMGTDTKGKQEVEAELLVKASVFTDEVAQSISIGEAQHAVAQGLIQESDVAQIGAVINGTNPGRTSDDQITLFDGTGVGLQDLAVAASVVEVAVEKGIAIEVDF

SEQ ID NO: 251 - protein, 321 aa, Cribrihabitans marinus DSM 29340
MLIVPEREIADLMTREAAFDAVEKVFAAMASGDAYNFPVVREAIGHEDALYGFKGGFDRAGLTLGLKAGGYWPNNLDKRGIINHQSTVFLFDPDTGMVKAMVGGNLLTALRTAAASSVSIRHLARKDARVIGMIGAGHQARFQLRAALEQRDFEKVIGWNFHPEMLPNLQEVAEAAGLPFEAVELDGMREADVIVSITSSFDAILGADQVSPGTHVACMGTDTKGKKEVDPQLLVRADVFTDEVAQSVSIGEAQHAVGRGLISEADVAQLGAVINGSHAGRSSDDQITLFDGTGVGLQDLAVAAAVVDLAVERGIAIEVDF

SEQ ID NO: 252 - protein, 321 aa, Ruegeria mobilis DSM 23403
MYIVPERAIADLMTRDAAFDAVEKVFAAMAAGDAYNFPVVREAIGHEDALYGFKGGFDRAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLLNLEEVATEAGLPFEAVELDGMRAADVIISITSSFDAILKADQVSPGTHIACMGTDTKGKQEVDPQLLVRATVFTDEVAQSTSIGEAQHAVAQGLIGEADVAQLGAVINGAHPGRTSAEQITLFDGTGVGLQDLAVAASVVELAVKKGIAIEVDF

SEQ ID NO: 253 - protein, 321 aa, Pseudopelagicola gijangensis DSM 100564
MWIVPEREIAGLMTREAAFGAVEKVFSSMASGDAHNFPVIREAIGHEEALYGFKGGFDRAGAALGLKAGGYWPHNLEKRGLINHQSTVFLFDPDTGKASAMVGGNLLTALRTAAASSVSIKHLARSDAKVIGMVGAGHQATFQLRAALEQRNFDKVIGWNLHPEMLPNLEKVATQAGLPFEAVELDGLHEADVIITITSSFEASLMSHHVSDGTHIACMGTDTVGKQEVEPALIERASVFTDEVAQAISLGESQHAVCAGTKAESDINEIGAVINGTHRGRKSDDEVTLFDGTGVGLQDLAVAASVVDLAIAKGVAIEVDF

SEQ ID NO: 254 - protein, 327 aa, Ruegeria atlantica CECT 4293
MTTQDGLLIVGEDLCEQLVGRQQAFDAVQSVFGAMANGGARNFPVVREALGYADALYGFKSGFDRDGQVLGVKSGGYWPGNAEQGLTNHQSTVFLFDPDTGRLSALVGGNYLTAVRTAASSAVSIAQLARKDAKVLGMVGAGHQSAFQLRAAAEQRDFEKVVAWNPHPDMLPRLAAVAEEIGLEFEAVSQQELGAQSDVIITITSAFEPLLMKDWIKPGTHLACMGTDTKGKMEVDPALVASATVFTDEVAQSATIGEAQHAMGSGTLTETQITPIGAVINGDHPGRSSADEITLFDGTGVGLQDLAVASVAARLADEAGLAQRATL

SEQ ID NO: 255 - protein, 331 aa, Thalassobacter stenotrophicus CECT 5294; identical to SEQ ID NO: 238

SEQ ID NO: 256 - protein, 321 aa, Loktanella sediminilitoris DSM 29955
MLIVPEREIADLMTRDAAFDAVEKVFAAMAAGDAYNFPVVREAIGHEDALYGFKGGFDQAGLTLGLKAGGYWPHNLEKRGIINHQSTVFLFDPDTGKAKAMVGGNLLTALRTAAASSVSIKHLARDDASVIGMIGAGHQATFQLRAALEQRQFEKVIGWNYHPDMLPNIEKVATEAGLPFEAVELEGMVDADVIISITSAFAPSLMADHVSPGTHIACMGTDTKGKQEVEAALLARAAVFTDEVAQSISIGEAQHAIGAGLIAETDINQLGAVINGTHAGRTSDDQITLFDGTGVGLQDLAVAAAVVDLAVQKGIAIEVDF

SEQ ID NO: 257 - protein, 321 aa, Rhizobium taibaishanense DSM 100021T
MLIVPEREIANLITAADCFTAVERVFASMANKAAYNFPVIREAIGHADALYGFKSGFDRESLALGLKAGGFWPNNVSKGLTNHQSTIFLFDADTGKCRAAVGGNLITALRTAAASAVSIKYLARQEAKVLGMIGAGHQSAFQLRAALQQRQFEKVVAWNFHPEMLSRLEQVANDEGLPFEVLDLERLGAESDVIISITSSFAPLLKASQVRPGTHVACMGTDTKGKQEVEPELVAMATVFTDEIAQAVTIGECQHAVERGITNKEAIIEIGAVISGKHPGRSSADEITLFDGTGIALQDLAVASVAVELALVKGVAIEIDF

SEQ ID NO: 258 - protein, 321 aa, Rhodobacteraceae bacterium JGI 01_L11_4000m (contamination screened)
MLIVPEREIADLMTRAAAFDAIEKVFAAMASGDAYNFPVVREAIGHEDALYGFKGGFDRAGLTLGLKAGGYWPNNLEKRGLINHQSTVFLFDPDSGKVKAMVGGNLLTALRTAAASSVSIKHLARKDASVLGMVGAGHQATFQLRAALEQRNFEKVIGWNYHPEMLPNIEKVAQEAGVPFEAVDLPAMTEADVIISITSAFAPSLMADHVSPGTHVACMGTDTKGKQEVEAALLGRAAVFTDEVAQSVSIGEAQHAIAEGIITETDVAQLGAVINGDHPGRISKDQITLFDGTGVGLQDLAVAAKVVDLAVEKGIAVEVDF

SEQ ID NO: 259 - protein, 321 aa, Sulfitobacter sp. HI0054; identical to SEQ ID NO: 258

SEQ ID NO: 260 - protein, 321 aa, Labrenzia aggregata CECT 4801
MIIVPEKEIAGLIGRQESFDAVESVFAAMAGGAAYNFPVIREAIGHADALYGFKSGFDRSSLALGLKSGGYWPGNMAKGLTNHQSTVFLFDADTGKAKAVVGGNLLTALRTAAASAVSIKHLARKDAKVLGMIGAGHQSAFQMRAAVEQRDFEKVLGWNLHPEMLVRLEETANELGLPYESVDLARLGAEADVIISITSSFDPILMEEHVSPGTHIACMGTDTKGKQEVDVALVAKAKLFTDEIAQSATIGECQHAVASGIVSEDNIIEIGAVINGNHPGRTSQSDITLFDGTGVGLQDLAVASAAVDLAIQKGVAIEVDF

SEQ ID NO: 261 - protein, 321 aa, Roseovarius nubinhibens ISM
MLIVPERQIPDLLTRSASFTAVEKVFAAMAAGQAYNFPVIREAIGHEDALYGFKGGFDRDGHTLGLKAGGYWPHNLEKRGLINHQSTVFLFDPDSGMISAMVGGNYMTALRTAAASAVSIQHLARPDAKVIGMIGAGHQATFQLRAALEQRPFEKVIGWNLHPEMLPNLAAVAEEAGLPFEAVELDGMTEADVIITITSSFAPSLLAQHVSPGTHIACMGTDTKGKQELEAALLGSATVFADEIDQSITLGEAQHAIATGLISRDDITEIGAVINGTHPGRSSAEEITLFDGTGVGLQDLAVAAAVVDLAVEQGVAIEVDF

SEQ ID NO: 262 - protein, 321 aa, Roseobacter sp. SK209-2-6
MYIVPEREIAGLMTREASFAAVEKVFAAMAAKDAYNFPVIREAIGHEDALYGFKGGFDRAGQTLGLKAGGYWPNNLEKRGLINHQSTVFLFDPDTGKASAMVGGNLLTALRTAAASSVSISHLARKDAKVIGMIGAGHQAKFQLRAALEQREFEKVIGWNLHPEMLPNLQEVADEAGLPFEAVELDGMREADVIISITSSFDAILGADQVSPGTHLACMGTDTKGKQEVDPALLVKATVFTDEVAQSISIGEAQHAIAQGLIGEGDIAQLGAVINKAHPGRQSDEEVTLFDGTGVGLQDLAVASAVVDQAVKTGIAIEVDF

SEQ ID NO: 263 - protein, 321 aa, Rhodobacterales bacterium HTCC2083 scf_1106200183017 genomic scaffold
MWIVPEREIADLLTRDASFEAVENVFAAMAAGDAYNFPVIREAIGHEDALYGFKGGFDGVGGTLGLKAGGYWPHNLEKRGLINHQSTVFLFDPDTGKVAAMVGGNYLTALRTAAASSVSIKHLARADAKVMGMVGAGHQATFQLRAALEQRAFEKVIGWNYHPEMLPNIEKVANEAGVPFEAVELDGLGEADVVISITSTFAPTIMAEHISAGTHIACMGTDTKGKQEVEAALLARASVFTDEVAQSVSIGEAQHAIAERLIAVSDVTQIGAVINGTHEGRTSEEEITLFDGTGVGLQDLAVSAAIVRMAIEQGVAIEVDF

SEQ ID NO: 264 - protein, 321 aa, Agrobacterium sp. ATCC 31749 AGT22
MIIVPEHEIESLVSASDCFTAVERVFASMAQKSAYNFPVIREAIGHADALYGFKSGFDRESLALGLKSGGFWPNNIEKGLTNHQSTIFLFDADTGKCRAVVGGNLLTALRTAAASAVSIKYLARPDAKVLGMVGAGHQSTFQLRAALEQRAFEKVVGWNIYPEALDRLAKIAAEHDVPFEAVDLDRLGAEADVIITITSAFAPILKAAQIRRGTHLACMGTDTKGKQEVEAELLAAATIFSDEIAQSVTIGEAQHPVARGLISPDRITEIGAVINGAHPGRTNADEITVFDGTGVGLQDLAVASKAVDLAVQKGVAVVVDF

SEQ ID NO: 265 - protein, 320 aa, Paracoccus sp. TRP Paracoccus_TRP_Contig_10
MYVVAEKEIAGLMNPEAAFEAIEAVFAAMARRKAYNFPVVREAIGYEDALYGFKGGFDASGLALGLKAGGYWPNNQKHGLINHQSTVFLFDPDTGRVSAAVGGNLLTALRTAAASAVSIKYLAPIGAKVLGMIGAGHQSAFQMRAAANVHGFEKVIGWNPHPEMLSRLADTAAELGLPFEAVDLPQLGEEADVIISITSSFSPLLLNEHVKGPTHIAAMGTDTKGKQELDPALVTRARIFTDEVAQSISIGECQHAIAAGLIKEEQISELGAVVTGDNPGRADAEVTLFDGTGVGLQDLAVAQKVLEIAKEKGIAQQVEI

SEQ ID NO: 266 - protein, 321 aa, pAqui_F126
MYIVPEKAIADLVTREASFDAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQAKFQLRAALEQRSFEKVIGWNLHPEMLPNLQEVADEAGLPFEAVELDGMREADVIISITSSFDAILKADQVSPGTHVACMGTDTKGKQEVDPQLLVAADVFTDEVAQSVSIGEAQHAIAQGLIQKGDVAQIGAVINGINPGRTSDDQITLFDGTGVGLQDLAVAASVVDVAVEKGIAIEVDF

SEQ ID NO: 267 - protein, 274 aa, Ruegeria mobilis F1926
DALYGFKGGFDSAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLPNLKEVATEAGLPFEAVELDGLKEADVIISITSSFDAILKADQVSPGTHIACMGTDTKGKQEVDPQLLVRATVFTDEVAQSISIGEAQHAVAQGLITEADVAQLGAVINGAHPGRSSAEQITLFDGTGVGLQDLAVAASVVELAVKKGVAIEVDF

SEQ ID NO: 268 - protein, 321 aa, Oceanicola sp. HL-35
MLIVPEREIADLMTREAAFEAVEKVFAAMAAGDAYNFPVVREAIGHEDALYGFKGGFDRAGLTLGLKAGGYWPNNLDKRSIINHQSTVFLFDPDTGKARAMVGGNLLTALRTAAASSVSIRHLARKDAKVIGMIGAGHQAKFQLRAALEQRGFEKVIGWNLHPEMLPNLEEVASEAGLPFEAVELDGMTEADVIITITSSFGAILSAGQVSPGTHVACMGTDTTGKQEVEPALLGHATVFTDEVAQSVSIGEAQHAVSQGLIAESDIAQLGAVINGSHPGRISDHQITLFDGTGVGLQDLAVAAAVVDLAVEKGIAIEVDF

SEQ ID NO: 269 - protein, 333 aa, Psychrobacter sp. G
MSEANSVNSDEGLLIVSEDACKSVIDRPSAFIAVENVFASMSRGDAYNFPVIREAIGYADALYGFKSGFDRAGKSLGLKSGGYWPGNAAKGLTNHQSTIFLFNPDNGKLRALVGGNYLTAVRTAAASAVSIAHLARKDSKVLGMVGAGHQSTFQLRAALEQRNFEKVVAWNKNKDRLKNLQAVAEELGVPFEAVEREQLCSEADVIITITSAFEPLLMKEWIKPGTHIACMGTDTVGKQEVDVNLVAAATVFTDEIAQSISLGEAQHAIKSGAIKESDITTLGDVINGDHPGRSSDDEITLFDGTGVGLQDLAVASAAAKLALEKGEAQHISL

SEQ ID NO: 270 - protein, 321 aa, Ensifer meliloti Rm41
MIIVPENQIAGLITPADCLVAVEGVFASMAKRSAYNFPVIREAIGHADALYGFKSGFDRDSLALGLKSGGFWPNNVQKGLANHQSTVFLFDADTGRCRAMVGGNLLTALRTAAASAVSIKYLARKDAKVLGMIGAGHQSTYQLRAAVEQRPFEKVLAWNLHPEMLSRLEGVARELELPFETVDLDRLGDESDVIISITSSFAPILKASQVRPGTHLACMGTDTKGKQEMDAELIAAATVFADEVAQAITIGECQHAIEKGLISRDDIVEIGAVITGRHPGRSSPEEITLFDGTGVGLQDLAVASAAVELALSNGTAIEVDF

SEQ ID NO: 271 - protein, 334 aa, Roseovarius sp. MCTG156(2b)
MMNTHVETTADGFVIVGEEICQKIISRADAFGAVEAVFAAMARGDAYNFPVVREAIGHADALYGFKGGFDRSGLSLGLKAGGYWPGNMDKGLTNHQSTVFLFDPDTGRLSALVGGNYLTALRTAASSSVSIAHLAREDSKVLGMVGAGHQSAFQLRAAVEQRSFEKVVAWNPHPDMLPRLGAVAEELGLEFEAVTQEELGAQADVIITITSAFEPLMMADWVKPGTHIACMGTDTKGKQEVDPALFTRATVFADEIAQSVSIGEAQHAVAQGLISEGDITPIGAVINGTHAGRASAEEVTLFDGTGVGLQDLAVASVAAKLARDQGLVTPITLG

SEQ ID NO: 272 - protein, 321 aa, Rhizobium rhizogenes OK036
MIIVPETEIAGLVTAADCFKAVEGVFASMANKSAYNFPVVREAIGHADALYGFKSGFDRKGLALGLKAGGFWPNNVHRGLTNHQSTVFLFDPDTGKCRAVVGGNLLTALRTAAASAISIKYLARKDAKVLGMIGAGHQATFQLRAALAQRQFEKIVGWNLHPDMLSRLEEVAKEEGLPFEAVDLDRLGAEADVIISITSSFAPMLKASQVRAGTHLACMGTDTKGKQEIEAEILVKATVFTDEVAQAVTIGESQHAIERGLIREEAIVEIGAVINGTHPGRISADQITLFDGTGVGLQDLAVASAAVELALAKGVAIEVDF

SEQ ID NO: 273 - protein, 321 aa, Rhizobium leguminosarum YR374; identical to SEQ ID NO: 166

SEQ ID NO: 274 - protein, 321 aa, Methylobacterium sp. YR668; identical to SEQ ID NO: 180

SEQ ID NO: 275 - protein, 321 aa, Sinorhizobium americanum CCGM7
MIIVPENQIAGLITPADCLVAVERVFASMAEKSAYNFPVIREAIGHADALYGFKSGFDRDSLALGLKSGGFWPHNVEKGLANHQSTVFLFDADTGRCRAMVGGNLLTALRTAAASAVSIKYLARKDAKVLGMIGAGHQSTYQLRAAVEQRPIEKVLAWNLHPEMLSRLEEVARELELPFETVDLDRLGAEADVIISITSSFAPILKASQIRPGTHLACMGTDTKGKQEVDPELVAAATVFTDEVAQAVTIGECQHAIDKGLISKDDIVEIGAVITGRHKGRSSSEEITLFDGTGVGLQDLAVASAAVELALSKGAAIEVDF

SEQ ID NO: 276 - protein, 321 aa, Palleronia marisminoris DSM 26347
MLIVPEREIANLMTREAAFDAVEKVFAAMASDDARNFPVVREAIGHEDALYGFKGGFDRAGLTLGLKAGGYWPHNLEKHELINHQSTVFLFDPDTGRAKAMVGGNLLTALRTAAASSVSIKHLAREDAKVIGMIGAGHQATFQLRAALEQRRFEKVIGWNYHPEMLPNIEKVATEAGLPFEAVDLPGMAEADVIITITSAFAPSLMADHVSPGTHIACMGTDTKGKQEVETALLGRATVFTDEVAQSISIGEAQHAIQDLSLRPEDIIQLGRVINGSHEGRTSDDEITLFDGTGVGLQDLAVAAAVVDLAVEKGISIEVDF

SEQ ID NO: 277 - protein, 320 aa, Paracoccus aminovorans DSM 8537
MFVVAEKEIAGLMTPEAAFEAIEAIFASMARRKAYNFPVVREAIGHEDALYGFKGGFDASALTLGLKAGGYWPNNQKHNLINHQSTVFLFDPDTGRVSAAIGGNLLTALRTAAASAVSIKYLAPQGAKVLGMIGAGHQSAFQMRAAAAVHQFEKVIGWNPHPEMLGRLAETAADLGLPFEAVELDRLGAEADVIISITSSFSPLLMNEHVKGPTHIAAMGTDTKGKQELDPALVARARVFTDEVAQSVSIGECQHAIAAGLIAEDQIGELGAVVAGDDPGRGDAEVTIFDGTGVGLQDLAVAAKVLEIAKEKGVAQTVEI

SEQ ID NO: 278 - protein, 321 aa, Yangia pacifica CGMCC 1.3455; identical to SEQ ID NO: 216

SEQ ID NO: 279 - protein, 321 aa, Roseovarius indicus DSM 26383
MIIVPEREIADLMTREAAFEAVERVFAAMAAGEAYNFPVVREAIGHEDALYGFKGGFDRSGLTLGLKAGGYWPHNLAKRGVINHQSTVVLFDADTGRVHAMVGGNLLTALRTAAASAVSIRYLAREDARVLGMIGAGHQAAFQLRAALEQRRFEKVIGWNLNPEMLPNLEKVAEEAGVPFEAVELGGMREADVIISITSSFEAILGADQVSPGTHVACMGTDTKGKQEVAPGLLARAVVFTDEVAQSVSIGEAQHAVAMGLIGEGDVQQLGAVINGAHPGRRSAEEITLFDGTGVGLQDLAVASRVVELAQEAGRAVMVDF

SEQ ID NO: 280 - protein, 321 aa, Jannaschia rubra DSM 16279; identical to SEQ ID NO: 69

SEQ ID NO: 281 - protein, 321 aa, Rhizobium etli bv. phaseoli IE4803
MIIVPERAIADLIGSAECFTAVEQVFAAMARKSAYNFPVVRESIGYADALYGFKSGFDRESLSLGLKSGGFWPKNVEKGLTNHQSTVFLFDADTGRCRAVVGGNLLTALRTAAASAISIKYLAREDAKTLGIIGAGHQSTFQLRAAVEQRNFEKVVAWNYHPEMLNRLAEVAREIGLPFEAVDLDRLGAEADVIISITSSFSPSLMAAQVRPGTHLACMGTDTKGKQEVDAKLVAASSIFTDEVAQAITIGECQHAIADGLIGEADILEIGAVITGDVKGRRSADDITLFDGTGVGLQDLAVAAAVVDLAVREGVAIEVDF

SEQ ID NO: 282 - protein, 321 aa, Roseivivax sediminis DSM 26472
MLIVPEREIADLMTREAAFAAVEKVFAAMASGDAYNFPVVREAIGHEDALYGFKGGFDRAGLTLGLKAGGYWPNNLDKRGIINHQSTVFLFDPDTGKAKAMVGGNLLTALRTAAASSVSIRHLARKDAKVIGMIGAGHQAKFQLRAALEQRDFDKVIGWNLHPDMLPNLEEVAAEAGLPFEAVELDGMQEADVMISITSSFDAILSAGQVAPGTHIACMGTDTKGKQEVDPQLLAKATVFTDEVAQSVSIGEAQHAVAQGLIAEGDIAQLGAVINGSHKGRASDEEITLFDGTGVGLQDLAVANAVVELAVEKGIAIEVDF

SEQ ID NO: 283 - protein, 321 aa, Agrobacterium sp. KFB 330
MIIVPEHEIEGLVSASDCFTAVERVFASMAQKSAYNFSVIREAIGHADALYGFKSGFDRESLALGLKSGGFWPNNMEKGLTNHQSTIFLFDADTGKCRAVVGGNLLTALRTAAASAVSIKYLARPDAKVLGMVGAGHQSSFQLRAALQQRPFEKVIGWNLFPEALDRLAKVAAEHDVPFEAVDLDRLGAEADVIITITSSFAPILKAAQIRPGTHLACMGTDTKGKQEVEAELLAAATIFSDEIAQSVTIGEAQHPVAKGLISPNRIIEIGAVINGAHPGRSNADEITVFDGTGVGLQDLAVASKAVDLAVQKGVAVVVDF

SEQ ID NO: 284 - protein, 321 aa, Leisingera sp. ANG-DT; identical to SEQ ID NO: 250

SEQ ID NO: 285 - protein, 321 aa, Methylobacterium sp. ME121
MIIVPEHAIDGLLTEAECFGAVEQVFASMARRRAGNFPVVREAIGHADAIYGFKSGFDRDSLALGLKAGGFWPGNAAKGLTNHQSTVFLFDADTGRCRAVVGGNLLTALRTAAACAISIRHLAREGARVLGMIGAGHQSAFQLRAALAQRPFERVLAWNLHPGMFGRMEAVARERGVPFEVVDLDRLGAEADVVVTITSSFAPILKAAQVRPGTHVACMGTDTRGKQEVEAELLAAATVFTDEVAQSVSLGEAQHAVARGLLAADSIVEIGAVINGDHPGRVSDAEITVFDGTGVGLQDLAVAAVAVDRALAKGLATEVGF

SEQ ID NO: 286 - protein, 321 aa, Litoreibacter meonggei DSM 29466
MLIVPEREIADLMTREAAFDAVEGVFAAMASKDAYNFPVIREAIGHEDALYGFKGGFDKAGMTLGLKAGGYWPNNLEKHGHINHQSTIFLFDPDTGMVSAMVGGNLLTALRTAAASSVSIKHLARKDAKVMGMVGAGHQATFQLRAALEQRQFEKVIGWNYHPEMLPNIEKIANEAGLPFEAVELEGMREADVVISITSTFAPTIMADHIAPGTHIACMGTDTKGKQEVEAALLARATVFTDEVAQSVSIGEAQHAVAQGLIKESDVHQLGAVINGTDKGRASDDEITLFDGTGVGLQDLAVAASVVELAVQKGVAIDVDF

SEQ ID NO: 287 - protein, 321 aa, Litoreibacter halocynthiae DSM 29467
MLIVPEREIANLMTRDAAFDAVEGVFAAMASKDAYNFPVIREAIGHEDALYGFKGGFDKAGMTLGLKAGGYWPNNLEKHGHINHQSTIFLFDPDTGMVSAMVGGNLLTALRTAAASSVSIKHLARKDAKVMGMVGAGHQATFQLRAALEQRQFEKVIGWNYHPEMLPNIEKIANEAGLPFEAVELEGMREADVVISITSTFAPTIMADHIAPGTHIACMGTDTKGKQEVEAALLARATVFTDEVAQSISIGEAQHAVAEGLIKESDVHQLGAVINGTHKGRTSDDEITLFDGTGVGLQDLAVAASVVELAVQKGVAIEVDF

SEQ ID NO: 288 - protein, 329 aa, Roseivivax lentus DSM 29430
MSNEKDGSVVIVTEEICQKVVDRASAFTAVEQVFGAMAKGDAYNFPVIREAIGYADALYGFKSGFDRVGGSLGLKSGGYWPGNAEKGLTNHQSTVFLFDPDTGRLQALVGGNYLTAVRTAASSSVSIAHLARKDAKVLGMVGAGHQSAFQLRAAAEQRDFERVVAWNPHPDMLPKLGEVAKDLGLDFEAVSQEELGAQADVIITITSAFEPLLMADWIKPGTHIACMGTDTKGKQEVDAALLARATVFTDEIAQSISIGEAQHAVGQGLIAEGDITPIGAVINGDHKGRTSEDEITLFDGTGVGLQDLAVASVAAKLARERGMAQTVML

SEQ ID NO: 289 - protein, 321 aa, Rhodovulum sulfidophilum DSM 2351
MFIVPEKEIAGLVSADQCFEAVEAVFAAMARGDAYNFPVIREAIGHAEALYGFKSGFDRAGSVLGLKSGGYWPGNAAKGLTNHQSTVVLFDPDSGRPAALVGGNLLTALRTAAASAVSIRYLARSDARVLGVLGAGHQSAFQLRAAVAQRRFEKIVGWNYHPEMLPRLAETAAELGLPFEAVSLEDLGAQADVIVTISSSFSAQLMDAHVRPGTHLACMGTDTKGKQEIDPAIFARARVFADEIAQSVEIGEAQHAVAAGLIAAEDIVEIGAVINGTAPGRQSDDEITVFDGTGVGLQDLAVAARAVAAARARGLAVEVDL

SEQ ID NO: 290 - protein, 325 aa, Roseobacter denitrificans DSM 7001; identical to SEQ ID NO: 5

SEQ ID NO: 291 - protein, 321 aa, Leisingera sp. ANG-Vp
MYIVPEKEIAGLMTREAAFDAVEKVFASMASGDAYNFPVVREAIGHEDALYGFKGGFDRAGLTLGLKAGGYWPNNLEKRGLINHQSTVFLFDPDTGKAKAMVGGNLLTALRTAAASSVSIKHLARKDAKVIGMIGAGHQAKFQLRAALEQREFEKVIGWNLHPDMLPNLQEVADEAGLPFEAVELDGMREADVIISITSSFDAILNAGQVSPGTHIACMGTDTKGKQEVDPQLLVAADVFTDEVAQSITIGEAQHAVAQGLIQEADVAQIGAVINGTNPGRTSDDQITLFDGTGVGLQDLAVAASVVDLAVAQGIAIEVDF

SEQ ID NO: 292 - protein, 321 aa, Marivita hallyeonensis DSM 29431
MYIVPEAKIADLVSREASFEAVEQVFAAMASKDAYNFPVVREAIGHEDALYGFKGGFDRVGGSLGLKAGGYWPHNLEKRGLINHQSTVFLFDPDTGRVHAMVGGNLLTALRTAAASSVSIKHLAREDAKVMGMIGAGHQATFQLRAALEQRSFEKVIGWNYHPEMLPNIEKVAQEAGLPFEAVELEGMREADVIISITSAFSPSLMADHVSEGTHIACMGTDTKGKQEVEAALLAKAKVFTDEVAQSISIGEAQHAVGSGLIAESDVIEIGAVINGAHPGRTSDSDITLFDGTGVGLQDLAVASKVVELAIERGVAIEVDF

SEQ ID NO: 293 - protein, 321 aa, Labrenzia alba CECT 7551
MIIVPEKEIAGLIGRVEAFEAVENVFAAMSSGAAYNFPVIREAIGHADALYGFKSGFDRSSLALGLKSGGYWPGNADKGLTNHQSTVFLFDADTGQAKAVVGGNLLTALRTAAASAVSIKHLAREDAKVLGMIGAGHQSAFQMRSAVEQRKFEKVIGWNFHPEMLSRLEETATELGLPYESVDLDRMGTEADVIISITSSFDPILMADQVTQGTHIACMGTDTKGKQEVDTGLVARATLFTDEVAQSATIGECQHAVAAGIVSRDNINEIGAVINGTHSGRTSESEITLFDGTGVGLQDLAVASAAVELAVQKGVAIEVAF

SEQ ID NO: 294 - protein, 321 aa, Thalassobius abyssi DSM 100673
MWIVPEREIAGLVSREAAFDAVEQVFAAMAAGRANNFPVVREAIGHENALYGFKGGFDQLGGALGLKAGGYWPNNLEKRGLINHQSTVFLFDPDTGRPVAMVGGNLLTALRTAAASSVSIQHLSRPDARVIGMVGAGHQATFQLRAALEQRSFEKVIGWNRHPEMLPNIQKVAEDADLPFEAVELGDLSEADVIITITSSFGPILMVDHVAPGTHIACMGTDTKGKQEVEARLLANSLVFTDEVAQSISIGEAQHAVASGALASDAVIEIGRVINGDHPGRQSADEITLFDGTGVGLQDLAVAAKVVDLAIEKGVAIKVDI

SEQ ID NO: 295 - protein, 321 aa, Roseovarius indicus B108 cultivar; identical to SEQ ID NO: 279

SEQ ID NO: 296 - protein, 321 aa, Litoreibacter ponti DSM 100977
MYIVPESAIADLISAEASFDAVEAVFASMAKGDAYNFPVIREAIGHEEALYGFKGGFDGKGMALGLKAGGYWPHNLEKRGLINHQSTVFLFDPDTGRVASMVGGNLLTALRTAAASSVSIKHLARKDARVMGMIGAGHQAKFQLRSALQTHAFEKVISWNYHPEMLPGMAEVAAEFDLPFEEVQLEGMTEADVVISITSSFAPIFGPDHIAPGTHVACMGTDTIGKQECEAELLARATVFTDEVAQSISIGEAQHAVKAGLIMETEVNQIGDVINGVHKGRSSDDEITLFDGTGVGLQDLAVAQSVVEIAVERGVAIEVDF

SEQ ID NO: 297 - protein, 321 aa, Yangia sp. CCB-MM3
MLIVPEREIASLMTRDAAFAAVEKVFAAMAAGDAYNFPVVREAIGHEDALYGFKGGFDRSGLTLGLKAGGYWPNNLATRGIINHQSTVFLFDPDTGKAKAMVGGNLLTALRTAAASSVSIRHLAREDARVIGMVGAGHQATFQLRAALEQREFDKVIGWNLHPEMLPNLEKVAAEAGVPFEAVDLPGMREADVIISITSSFDAILMAEHVSPGCHIACMGTDTKGKQEVSPALLAKATVFTDEVAQSVSIGEAQHAVAQGLIDESAITQLGAVINGAHPGRASAEEITLFDGTGVGLQDLAVAAAVVDLAVEKGIAIEVDF

SEQ ID NO: 298 - protein, 321 aa, Granulosicoccus antarcticus IMCC3135
MFVVSEEVCRKVVSRADAFDAVQAVFAAMARGDARNFPVVREALGHADALYGFKSGFDRAGLALGVKSGGYWPGNAQKGLTNHQSTVFLFDPDTGQLQALVGGNYLTAIRTAAASAVSIAHLARKDARVLGMIGAGHQAQFQLRAAAEQRQFEKVIAWNLHPEKLSILEAVATELGLPFEAVGRQQLAEQADTIITITSAHEALLDSGWIRPGTHIACMGTDTAGKQELDPQLFSDASVFTDELAQSITIGEAQHAFKAGQLQEADITALGAVINGDHPGRVTDDEITVFDGTGVGLQDLAVAAVALRVACEEGDAKEIAL

SEQ ID NO: 299 - protein, 321 aa, Tateyamaria omphalii DOK1-4
MLIVPEKDIADLMTRDAAFDAVEQVFAAMASDDAYNFPVVREAIGHEDALYGFKGGFDRAGATLGLKAGGYWPHNLEKRDLINHQSTVFLFDPDTGKPAAMVGGNLLTALRTAAASSVSIKHLARPDAKVLGMIGAGHQATFQLRAALEQRAFDRVIGWNYHPDMLPNIAKVAEDAGLPFEAVDLPGMAEADVIISITSAFAPSLMADHVSPGTHIACMGTDTKGKQEVEAALLARATVFTDEVAQSISIGEAQHAIAAGLIAESDIHQIGAVINGAHPGRTSDTDITLFDGTGVGLQDLAVAARVVDLAQKKGIAIHVDF

SEQ ID NO: 300 - protein, 396 aa, Silicibacter pomeroyi DSS-3 megaplasmid
MSFQNPVFIPGPTNIPESLRKACDMPTIDHRSPLFGQILHPARAGVRAVLKSETAEIFIFPSTGTGGWETALTNTLSAGDGVLAARNGMFSHRWIDMCQRHGLAVEVVETPWGEGLPADRYEEILAADTHHRIKAVLATHNETATGVRSDIAAVRRALDKAGHPALLFVDGVSSIGSMDFRFDEWRVDVAVTGSQKGFMLPAGLAIVGFSAKAMEATATGTLPRTFFDVHDMARGYANNAYPYTPAVGLMNGLNQACRMLLDEGLENVFARHHRIAEGVRAAVHAWGLELCAASPDLYSDTVSAIRTPEGFNATDIVTHAASKYGVAFGVGLGEVAGKVFRIGHLGSLTDVMTLSGIATAEMCMADLGLDIGLGSGVAAAQEYFRSHSATSLLAAA

SEQ ID NO: 301 - protein, 396 aa, Silicibacter sp. TM1040
MSFQNPVFIPGPTNIPESLRKACDMPTIDHRSPLFGQILHPAREGVRKVLKSDSAEVFIFPSSGTGGWETALSNTLSPGDTVLAARNGMFSHRWIDMCQRHGLEVEIIETPWGEGLPADRYEEILTADTSHKIKAVLATHNETATGVKSDIAALRRALDAAAHPALLFVDGVSSIASMDFRMDEWGVDVAVTGSQKGFMLSAGLAIVGFSAKAMDATQSARLPRTFFDVHDMAKGYANNAYPYTPAVGLMNGLNESCKMLLAEGLEDVFARHHRIAEGVRAAVGAWGLELCAATPEVYSDTVSAIRTPEGFNATDIVTHAAEKYGVAFGVGLGEVAGKVFRIGHLGSLTDVMALSGIATAEMCMVDLGLDIRLGSGVAAAQDYYRGHTAAAQKDAA

SEQ ID NO: 302 - protein, 396 aa, Loktanella vestfoldensis SKA53
MSFQNPVFIPGPTNMPESIRKACDMPTIDHRSPLFGQILHPARANVQKVLKSANADVFIFPSTGTGGWETAITNTLSAGDTVLAARNGMFSHRWIDMCQRHGLDVQIVETPWGHGLPADRYAEALAADKGHKIKAVLATHNETATGVKSDIAAVRAALDAADHPALLFVDGVSSIGSMNFEFDAWGVDIAVTGSQKGFMLPAGLAILGFSAKARAATKTAGLPRTFFDVNDMAKGYDNSAFPYTPPVGLMNGLLLASDMLLREGLDNVFARHTRIASGIRAAVHAWGLELCAATPDLYSDTVSAIKTPAGFNATEIVNHAASAYGVAFGTGLGEVAGKVFRIGHLGSMTDVMALSGIATAEMCMVDLGLDIKLGSGVAAAQDHYRRTTGQALQDAA

SEQ ID NO: 303 - protein, 393 aa, Marinomonas sp. MED121
MSEQNPVFIPGPTNIPNRLLNAMHIQTQDHRSPNFVETLTPVLEGCKKVFGTTTGEVITFPSTGTGGWEAAISNTLSAGDKVLIARYGMFSHRWIDLCQRHGLEVVVIECPWGDGAPADLFEEALNADNNHDIKAVLVTHNETATGVRSDIAGVRKAMNNVNHPAMLFVDCVSSLASMPFEMDAWEVDIAISGSQKGFMLTTGMAILGVSQKALAAMETANLPRTFFDFRDMMGANANGGFPYTPPLQLIFGMKESLDMLFDEGLENVYARHFRLAEGVRQAVAAWGLKLCANTPELASDSVSAIYVPEGFDSNELTAHAFDKYGVSFGIGLGEMNGKAFRIGHLGSLTDVMVLSGLATIEMAMADLDYPIQLGAGVAAAQEYFRKTAKKANA

SEQ ID NO: 304 - protein, 396 aa, Paracoccus denitrificans PD1222 chromosome 2
MTSQNPIFIPGPTNIPEEMRKAVDMPTIDHRSPVFGRMLHPALEGVKKVLKTTQAQVFLFPSTGTGGWETAITNTLSPGDKVLAARNGMFSHRWIDMCQRHGLDVTFVETPWGEGVPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVETARLPRTFFDIRDMATGYARNGYPYTPPVGLINGLNASCERILAEGLENVFARHHRIASGVRAAVDAWGLKLCAVRPELYSDSVSAIRVPEGFDANLIVSHALETYDMAFGTGLGQVAGKVFRIGHLGSLTDAMALSGIATAEMVMADLGLPIQLGSGVAAAQEHYRQTTAAAQKKAA

SEQ ID NO: 305 - protein, 396 aa, Roseobacter denitrificans OCh 114
MSDQNPVFIPGPTNIPDRLRAAMQVQTRDHRAPDFVDTFAPVLQDTKKVFGTTSGRVITFPASGTGGWEAALCNTLSPGDKVLVARYGMFSHRWIDMCERHGLDVQVIECPWGTGAPADKFEASLSDDKSHAIKAVLVTHNETATGVKSDVAGVRAAMDASAHPALLFVDCVSSLASMPFEMDAWGVDIAVSGSQKGFMLATGMAILGVSEKALAAMQTASLPRTFFDFRDMMGANASGGFPYTPPLQLIYGMRESLKMLFEEGLDNVYARHTRLAEGVRCAVKAWGLELVAQNPSLYSDTVSAIYVPEGFDSNALTDQAFNQYGVSFGVGLGEMNGKAFRIGHLGSLTDVMVLSGLATIEMAMADLDYPIELGSGVAAAQEHFRSKSGAAIKSAA

SEQ ID NO: 306 - protein, 399 aa, Ahrensia sp. R2A130 contig00014
MSMQNPVFIPGPTNIPDELRRVIDFGTIDHRSSVFDEMLAPAIAGVKRILKTTDGEALVFPSTGTGAWEAAISNTLSPGDKVLVGCWGMFSHRWIDMCERHGLNVIVAEANWGDGVPLNAYAAALEGDTGHAIKAVLATHNETATGVKSDISAVRAVMNKAKHPALLMVDGVSSIASMDFRMDEWGVDLAIAGSQKGFMLPPGLAILGISQKAIAAMETAKLPRTFFDFRDMLTANGNGSFPYTPPVQLIRGLDHAIAMLESEGLDAVFARHARLAQGVREAVNAWCLKLCATSPDLYSDTVSAVLVPDGFDGTKVVTHAAEKYGVAFGVGLGEVSGKLFRIGHLGMLTDVMMCAGLSTAEMTMLDLGFPIKAGSGVTAAQEYYRNNPVATAQPMDKAA

SEQ ID NO: 307 - protein, 396 aa, Dinoroseobacter shibae DFL-12
MFDQNPIFIPGPTNVPDRLRRVMDMQTRDHRSPAFGAMLPELFDGVRKVFNTKDAAIITFPASGTGGWEAAVSNTLSPGDTVLIARYGMFSHRWIDLCQRHGLNVEIIECAWGSGAPADLFAERLKADKGHEIKAVLVTHNETATGVRSDIGAVRRGMDSADHPAMLMVDCVSSLASMPFDFDGWGVDVAITGSQKGFMLFTGMCIVAVSQKALEHRKTAKLPRTFFSFDDMLAANGAGGYPYTPPIQLMFGLQESLKMLFEEGLENVYARHFRLAEGVRRAVDAWGLRLCAESADLYSDTVSAIYVPKGFDSNALTQHAYDAYDISFGVGLGEMNGRAFRIGHLGALTDVTMLSGLATIEMAMADLDYPIELGSGVAAAQQFYRTTAGASLAKAA

SEQ ID NO: 308 - protein, 388 aa, Octadecabacter arcticus 238
MSFQNPVFIPGPTNMPEAIRQACYMPTIDHRSPLFGKILHPMLDGVRRVLKSETAKIFVFPSTGTGGWETALSNCLNAGDKVLAARNGMFSHRWIDMCQRHGLDVHIVETPWGHGLPATEYEAILKADKNHAIKVVLATHNETATGVKSDIAAVRKALVAAGHPAMLFVDGVSSIGSMDFRMDEWGVDVAVTGSQKGFMLPAGLAIVGFSDRAMQATKTSTLPRTFFDVHDMQKGYDNDAFPYTPPVGLMNGLKLALEMIEDEGLENVFARHRRIATGVRHAVKAWGLELCAVSPDVYSDTVSAVKTPDGFNATDIVTRAADKYGMAFGVGLGEVAGKVFRIGHLGMLTDAMMLSGLGVAEMVMVDLGLDIKLGSGVAAAQEFYRHGV

SEQ ID NO: 309 - protein, 396 aa, pDaep_A276
MSFQNPVFIPGPTNMPEALRKAVDMPTLDHRSPLFGQILHPALAGVKKVLKSETAEIFVFPSTGTGGWETAITNTLNAGDKILAARNGMFSHRWIDMCQRHGLDVQVVETPWGAGIPADRYEEILTADKAHEIKVVLATHNETATGVKSDIAAVRRALDAAGHPALLFVDGVSSIASMDFRMDEWGVDIAVTGSQKGFMLPPGLAITGFSPKAMKAAETATLPRTFFDIKDMAKGYANSAYPYTPSVGLLNGLNMACGMLLDEGLENVFARHHRIAEGVRAAVRAWGLELCAVSPEVYSDSVSAIRTPEGFDANTFVSLAAEKYGVAFGTGLGEVAGKVFRIGHLGSLTDVMALSGIATAEMVMADLGLGIQLGSGVAAAQDYYRGNTASSAKAAA

SEQ ID NO: 310 - protein, 396 aa, Paracoccus sp. J56
MTSQNPIFIPGPTNIPEEMRKAVDMPTIDHRSPVFGRMLHPALEGVKKVLKSTQAEVFLFPSTGTGGWETAITNTLSPGDKVLAARNGMFSHRWIDMCQRHGLDVTFVETPWGEGIPADRFEEILTADKGHEIRVVLATHNETATGVKSDIAAVRRALDNAKHPALLFVDGVSSIGSMDFRMDEWGVDIAVTGSQKGFMLPPGLAIVGFSPKAMAAVETARLPRTFFDIRDMAQGYARNGYPYTPPVGLINGLNASCERLLSEGLENVFARHHRIAGGVRAAVEAWGLKLCAVRPELYSDSVSAIRVPEGFDANLIVSHALETYDMAFGTGLGQVAGKVFRIGHLGSLTDAMALSGIAVAEMVMADLGLPIKLGSGVAAAQEHYRQTTATALKKAA

SEQ ID NO: 311 - protein, 396 aa, Paracoccus aminophilus JCM 7686
MISQNPVFIPGPTNMPEALRRAVDIPTIDHRSAEFGRILHPALEGVKKVLKTKDAQVFVFPSTGTGGWETAISNTLSAGDKVLAARNGMFSHRWIDMCQRHNLDVTIVETPWGEGIPADRFEEILSADKGHEIRVVLATHNETATGVKSDIAAVRRALDAAGHPALLFVDGVSSIGSMDFRMDEWGVDIAVTGSQKGFMLPPGLAITAFSPKAMAAVESARLPRTFFDIRDMASGYARNGYPYTPPVGLINGLNESCKLLLAEGIDNVFARHRRIAEGVRKAVHAWGMELCAARPELYSDSVSAIKFPAGFDGNRFVSHAMDQYQVAFGTGLGEVAGKVFRIGHLGSLTDAMALLAISVAEMCLADMDLPVQLGSGVAAAQEHYRQTAGAALRKAA

SEQ ID NO: 312 - protein, 396 aa, Rhizobium rhizogenes YR147
MYMQNPVFIPGPTNMPEILRKAADMPTLDHRSPLFGEILRPALAGVKRVLKTEAASVYVFPSTGTGGWETAITNTLSPGDRVLAARYGMFSQRWIDMCQRHGLKVDIIEAAWGGGAPADRYEEILAADTAHEIKAVLVTHNETATGVKSEIAAVRRAIDAARHPALLFVDGVSSIASMDFRMDEWSVDIAVTGSQKGFMLPAGLAITAFSPKALAAVETAKLPRTFFDIRDMARSYANNAYPYTPAVGLLNGLKLSTELLLAEGLENVFARHRRIASGIRAAVRAWGLELCARSEDLYSDTVSAIRTPEGFDATSIVAHAARIYDVAFGVGLGEVAGKVFRIGHLGSLTDVMALSGIATAEMVMVDLGLNIKLGSGVAAAQEYYREGRASKIQAAA

SEQ ID NO: 313 - protein, 396 aa, Roseinatronobacter thiooxidans DSM 13087
MSAQNPVFIPGPTNIPEEIRKACDIPTLDHRSPAFARMFKPAVAGIRRVLGMQQGEVIILPSTGTGGWEAAITNSLSSGDRILTARFGMFSHRWIDMCQRHGLDVQVIEAPWGMGIPLAEMEAALRADTSHSIKAVLATHNETATGVKSDIAGLRRALDAAGHPALLFVDGVSSIGSMPFDMAGWGVDIAVAGSQKGFMLPAGLAILGVSPKALRAMDSATLPRTFFDFRDMLKAYAAGGYPYTPAVGLIAGLAKSIEMLEDEGLSHVYARHHRLAEATRRAVAAWGMSPCAATPDLYSDTVTAVVVPNGCDGTELVQLAATKYGVAFGVGLGEVAGKVFRIGHLGMLSDVMLLSGLATAEMCMADLGWKVQLGSGVAAAQDYLRKSANAALAEAA

SEQ ID NO: 314 - protein, 396 aa, Citreicella marina DSM 26424
MSFQNPVFIPGPTNIPERLRKACDMPTIDHRSPLFGQILHPAREGVRRVLKSDSAQIFIFPSTGTGGWETALSNCLSAGDTVLAARNGMFSHRWIDMCQRHGLGVEIVETPWGHGLPADRYEEILTADTGHRIKAVLATHNETATGVKSDIAAVRRALDAAGHPALLFVDGVSSIASMDFRFDDWGVDVAVTGSQKGFMLPPGLAITAFSAKAMAATDTATLPRTFFDVKDMAKGYANNAYPYTPAVGLLNGLNEACGMLLAEGLDNVFARHHRIAEGVRAAVRAWGLELCAVSPEVYSDTVSAIRTPEGFNATDIVSHAASAYGVAFGTGLGEVAGKVFRIGHLGSLTDVMALSGLATAEMVMADLGLDIRLGSGVAAAQDYYRGCRIETRKAAA

SEQ ID NO: 315 - protein, 396 aa, Ruegeria marina CGMCC 1.9108
MSDQNPVFIPGPTNIPDRLRRALQVQTRDHRAPDFVDTLAPVLSGIKTVLNTTDGNVVTFPSTGTGGWEAAITNTLSPGDRVLVARYGMFSHRWIDLCQRHGLDVRIIETDWGAGAPADRFEEELRADTGHRIKAVLVTHNETATGVLSDISAVRRAMDMAGHPALLFVDAVSSLASVPFRMDDWGVDIVVSGSQKGFMLTTGMAILGVSPKALGAIETARLPRTFFDFRDMMGANARGGFPYTPPLQLIYGMRESLNMLFEEGLENVYARHNRLAEGVRRAVDAWGLKLVAKSPELYSDTVSAIYVPDGFDSNALTDHAFHAYDVSFGIGLGEMNGRAFRIGHLGSLTDVMVLSGLATIEMAMADLNYPIRLGSGVAAAQEYLRRPAQAAAKSAA

SEQ ID NO: 316 - protein, 396 aa, Thalassobacter sp. 16PALIMAR09
MISQNPVFIPGPTNMPEVLRKSCDMPTLDHRSAAFADILHPALEGVKKVLKTTSAEVFVFPSTGTGGWETALTNTLSPGDTVLVGRNGMFSHRWIDMCERHGLDVIVLDTAWGQGLPVDRYGEVLAQDTEHRIKAVLATHNETATGVVSDIAGLRAAMDASAHPALLLVDGVSSIGSMNFEMDAWGVDIAVTGSQKGFMLPAGLAIVGVSQRALGAMATAKLPRTFFDLRDMQKGYAVNGYPYTPPVGLLNGLKLACDMLLEEGLENVFARHRRIADGVRAAVAAWGLELCAERPEWQSDTVSAVRTPEGFDAGEIVTHAAEVYDMAFGVGMGEVAGKVFRIGHLGMLTEAQALCGLATVEMCMVDLGLDIQLGSGVAAAQGVYRHGTRQQAMAAE

SEQ ID NO: 317 - protein, 396 aa, Salinihabitans flavidus DSM 27842
MSFQNPVFIPGPTNIPEALRRAVDMPTIDHRSALFAEILHPAREKVKAVLKSEAAEVFFFPSTGTGGWEVAITNTLCPGDRVLAARNGMFSQRWIDMCERHGLTVEVVETPWGDGIPADRFEEILTADAGHEIKAVLATHNETATGVTSDIAAVRRAMEAAGHPALLLVDGVSSIASMDFRMDEWGVDVAVTGSQKGFMLPAGLAIVGFSPRAMAAVERATLPRTFFDIRDMGRSYAANGYPFTPAVGLLNGLNQSCDMLLAEGLEAVFARHHRIAEGVRAAVRAWGLELCANAPELYSDSVSAIRTPEGVNATDIVTHAADVYGVAFGVGLGEVAGKVFRIGHLGSLTDVMALSGIATAEMCMADLGMDVTLGSGVAAAQEVYRRSAGNGRREAA

SEQ ID NO: 318 - protein, 396 aa, Paracoccus alcaliphilus DSM 8512
MSNQNPIFIPGPTNIPEVLRKAVDMPTIDHRSPVFGKILHPALEGVKKVLKSTQAEVFVFPSTGTGGWETAITNTLSAGDKVLATRNGMFSHRWIDMCQRHGLDVQVVMQEWGEGVPADKFEEILTADKGHEIKVVLATHNETATGVRSDIAAVRRALDAAGHPALLFVDGVSSIGCYDFRMDEWGVDIAVTGSQKGFMLPPGLAIVGFSPKAMAAVETAKLPRTFFDIRDMAKGYAANGYPYTPPVGLLNGLNVACEMLLEEGLENVFARHHRIAEGVRKAVSAWGLQLCAARPELYSDSVSAIRVPEGFDANKVVSHALNTYGVAFGTGLGDVAGKVFRIGHLGSLTDVMALSGIATAEMVMADLGLPVQLGSGVAAAQEHYRQSVAGAQQKAA

SEQ ID NO: 319 - protein, 396 aa, Paracoccus sp. PAMC 22219
VSTQNPIFIPGPTNIPEVLRKAVDMPTIDHRSPMFGKILHPALEGVKKVLKSTQAQVFFFPSTGTGGWETAITNTLSAGDAVLATRNGMFSHRWIDMCQRHRLDVQVVDQPWGEGIPTDRFEEILTADTAHRIKAVLATHNETATGVRSDIAAVRRALDRAGHPAMLFVDGVSSIACYDFRMDEWGVDVAVTGSQKGFMLPPGLAIVGFSPKAMAALDGAGLPRTFFDVRDMARGYAANGFPYTPPVGLLNGLKVATDMLLDEGLENVFARHHRIAEGVRQAVTAWGLTLCAARPALYSDSVSAIRTPDGFDANRIVSHALNTYGVAFGTGLGDVAGKVFRIGHLGMLTDVMALSGLATAEMVMVDLGLPVTLGSGVAAAQAHYRHSAGQACRQAA

SEQ ID NO: 320 - protein, 396 aa, Loktanella sp. 5RATIMAR09
MSFQNPVFIPGPTNMPEAIRKACDMPTIDHRSPLFGQILHPARAGVQEILKSETAEIFIFPSTGTGGWETALTNTLCAGDTVLAARNGMFSHRWIDMCQRHGLDMTIVETPWGHGVPADRYAEILQADKEHKIKVVLATHNETATGVKSDIAAVRKALDAANHPAMLFVDGVSSIGSMDFRFDEWGVDVAVTGSQKGFMLPAGLAIVGFSQKALAASKTAKLPRTFFDIADMTKGYAANAYPYTPAVGLMNGLLLATETLLKEGLENVFARHTRIASGVRAAVDAWGLDLCAASPDLYSDTVSAIKTPDGFNATDIVTHAAEKYGVAFGVGLGEVAGKVFRIGHLGSMTDVMALSGIATAEMCMVDLGLDIKLGSGVAAAQEYYRGTTGLKMRDAA

SEQ ID NO: 321 - protein, 387 aa, Psychrobacter urativorans R310.10B
MSQQNPIFIPGPTNIPDRLRRAMNVPSQDHRAPDFSDTFLPVLSGVKKVIGTQDGEVLLFTSSGTGGWEAAISNTLSPGDKVLIARYGMFSHRWIDMCQRHGLDVQVVECPWGTGAPADQFEAILSADTEHEIKAVMVTHNETATGVMSDISAVRKAMDSATHPALLFVDGVSSIASVPFEMDAWGVDVAVAGSQKGFMLATGMAVLGVSQKALSHMDEAKLPRTYFDFRDMLRANSNGGFPYTPPLNLIYGLRESLEMLSEEGLENVYARHYRLAEGVRQAVSAWGFKLCAQSPDLYSNTVSAIFVPEGFNSNELTDHAFNKYGISFGIGLGEMNGKAFRIGHLGSLTEVMVLAGLATIEMAMVDLDYPIKLGQGVAAAQEYYRNN

SEQ ID NO: 322 - protein, 396 aa, Leisingera sp. ANG-S
MSFQNPVFIPGPTNMPEALRKAVDMPTLDHRSPLFGQILHPALAGVKKILKSETAEIFVFPSTGTGGWETAITNTLNSGDKILAARNGMFSHRWIDMCQRHGLDVQVVETPWGEGLPADRYEEILTADTSHQIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVRAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNTASSTKAAA

SEQ ID NO: 323 - protein, 393 aa, Neptunomonas antarctica DSM 22306
MSDQNPVFIPGPTNIPDRVRHAMNVQTRDHRSPDFVKTFAPVLEDCKRVFGTEAGQVITFPSTGTGGWEAAICNTLSAGDTVLIARYGMFSHRWIDMCQRHDLHVEVIECPWGSGAPADLFRERLNKDSAHKIKAVLVTHNETATGVLSDIGAVRKAMNTTSHPAMLFVDCVSSLGSMPFKMDAWGVDIAIAGSQKGFMLTTGMAILAASPKALAAIETAQLPRTYFDFRDMMAANKNGGFPYTPPLQLIYGLKESLTMLFDEGLDNVYARHFRLAEGVRQAVAAWGFKLCANAPELYSHSVSAIYVPEGFDSNKLTDHAFNAYGVSFGIGLGEMNGKAFRIGHLGSLTEVMVLSGLAAIEMAMADLDYPITLGSGVAAAQEYFRKTAAANIG

SEQ ID NO: 324 - protein, 396 aa, Sinorhizobium fredii CCBAU 83753
MHMQNPVFIPGPTDMPEVLRKASDMPTIDHRSSLFGEILRPALAGVQKVVKSEAASIFVFPATGTGGWETAITNTLSPGDRVLAARNGMFSHRWIDMCQRHGLNVEIILASWGSGAPAERYEEILVADKAHEIKAVLVTHNETATGVRSDVAAVRRAIDAARHPALLFVDGVSSIASMDFRMDEWGVDVAVTGSQKGFMLPAGLAITAFSPKALAALETAKLPRTFFDVRDMAKSYAGNAYPYTPAVGLLNGLKVSTEILLAEGLENVFARHTRIASGVRAAVGAWGLELCATSEDLYSDTVSAIRTPEGFDATSVVTHAAKKYDVAFGVGLGEVAGKVFRIGHLGSLTDVMALSGIATAEMVMADLGLGVRLGSGVAAAQEYYRNNQVSAVQGTA

SEQ ID NO: 325 - protein, 396 aa, Sinorhizobium fredii CCBAU 83753
MSGYNHLFIPGPTNIPEQVRQAMNLPMEDMRSPRFPELTLPLFADVKKVFKNRNGRVFIYPSSGTGAWEAAMTNVLSPGDKVLMSRFGQFSHLWVDMAERLGFEVDCLDREWGTGVPVELYAERLAADKAHKIKAVFVTHNETATGVTSDVAAVRAALDACGHPALLFVDGVSSIGSIDFRQDEWGVDCAVSGSQKGFMLPAGLGFLSVSQKALDAAKTARHMRCYFSFEDMIKTNDTGYFPYTPPTQLLRGLRAALDLIFEEGLENIFARHHHLADGVRAAVSAWGLKLCATEPKWHSDTVSAIRLPEGVDGVEVIRHAYRTYNTSLGSGLSKVAGKVFRIGHLGSLNEVMVLGALSAAELTLLDCGVKIEPGVGVGAAIRQFRSAAATATAEAA

SEQ ID NO: 326 - protein, 396 aa, Defluviimonas indica DSM 24802
MSFQNPVFIPGPTNIPESLRKACDMPTIDHRSPLFGQILHPAREGVRKVLKSESAEVFIFPSTGTGGWETALSNTLSAGDKVLAARHGMFSDRWIDMCRRHGLDVQVVETPWGEGLPADRFEEILTKDKGHEIKAVLATHNETATGVKSDIAAVRRALDQAGHPAMLFVDGVSSIASIDFRFDAWKVDVAVAGSQKGFMLPAGLAIVGFSEKAMDATRTSTLPRTFFDVNDMAKGYKNNGYPYTPAVGLLNGLNQACGMLLQEGLENVFARHHRIAQGVRAAVGAWGLELCAVDPSVYSDTVSAVRTPAGFNATDIVTHAAHKYGVAFGVGLGEVAGKVFRIGHLGSLTDVMALSGIATAEMCMADLGLKIELGSGVAAAQDYYRGHAAVARKDAA

SEQ ID NO: 327 - protein, 393 aa, Marinomonas sp. S3726
MSEQNPVFIPGPTNIPNRLLNAMHIQTQDHRSPNFVETLTPVLEGCKKVFGTTTGEVITFPSTGTGGWEAAISNTLSAGDKVLIARYGMFSHRWIDLCQRHGLEVVVIECPWGDGAPADLFEAALNEDSNHDIKAVLVTHNETATGVRSDIAAVRKAMNNVNHPAMLFVDCVSSLASMPFEMDAWEVDIAISGSQKGFMLTTGMAILGVSQKALAAMETANLPRTFFDFRDMMGANANGGFPYTPPLQLIFGMKESLDMLFDEGLENVYARHFRLAEGVRQAVAAWGLKLCANTPELASDSVSAIYVPEGFDSNELTAHAFDKYGVSFGIGLGEMNGKAFRIGHLGSLTDVMVLSGLATIEMAMADLDYPIQLGAGVAAAQEYFRKTAKKANA

SEQ ID NO: 328 - protein, 396 aa, Oceanicola flagellatus CGMCC 1.12644
MSFQNPVFIPGPTNMPEAVRQACYMPTIDHRSPTFGKILHPCLDGVRKVLKSDSAKIYIFPSTGTGGWETALSNTLNKGDKVLAARNGMFSHRWIDMCQRHGLDVHVVETPWGEGLPADKYEEILKADKSHEIKVVLATHNETATGVKSDIAAVRKALDAAGHPAMLFVDGVSSIASMDFRFDEWGVDVAVTGSQKGFMLPAGLAIVGFSDKAVQATKSATLPRTFFDINDMQKGYDNNAFPYTPPVGLMNGLKLSLDMLLDEGIENVFARHHRIAEGVRKAIGAWGLELCAASPDVYSDTVSAIRTPEGFNATDIVTVAANDYGMAFGVGLGEVAGKVFRIGHLGSLTDAMMLSGLGVAEMVMVDLGLDVKLGSGVAAAQEYYRRDLKNGSKAAA

SEQ ID NO: 329 - protein, 396 aa, Phaeobacter inhibens S4Sm
MSFQNPVFIPGPTNIPESLRKACDMPTIDHRSPLFGQILHPARDGVRKVLKSEVAEIFIFPSSGTGGWETALTNTLSEGEKILAARNGMFSHRWIDMCQRHRLDVQIVETPWGEGLPADRYEEILAADKSHQIKAVLATHNETATGVKSDIAAVRKALDAAGHPALLFVDGVSSIASMDFRFDEWGVDVAVTGSQKGFMLTAGLAIVGFSPKAMDATKTGTLPRTFFDVHDMAKGYANNAYPYTPAVGLMNGLNESCKMLLSEGLENVFARHTRIAQGVRAAVTAWELELCAVSPDVYSDTVSAIKTPDGFNATDIVTHAAETYGVAFGVGLGEVAGKVFRIGHLGSLTDVMTLSGIATAEMCMADLGLDVPLGSGVAAAQEYYRSNPAATALKAA

SEQ ID NO: 330 - protein, 396 aa, Brevirhabdus pacifica DSM 27767
MSFQNPVFIPGPTNIPEVIRKACDMPTIDHRSSVFGEIFAPVRENLKKVLKTTSGEIIIFPASGTGAWEASISNTLSPGDKVLAARNGMFSHRWIDMCQRHGLEVQIVETPWGEGIPANKYQEILAADKGHEIKAVLATHNETATGVRSDIGAVRAAMDAAKHPALLMVDGVSSVASMDFRMDDWGVDLAVTGSQKGFMMPAGLAICGVSQKALSHMDAAKLPRTFFDFRDMLNAYAAGGYPYTPAVGLLNGLNTSVNMLLDEGLEAVFDRHHRIAEGVRRAIAAWGLKPCAANPSLYSDTVTAVVVPEGFNGSAVATHAAEAYGMAFGVGLGEVATKVFRIGHLGSLTEAMMLSGLSVAEMSMVDLGIPVKLGSGVAAAQEYYRVGSAAMQAAAE

SEQ ID NO: 331 - protein, 396 aa, Methylobacterium radiotolerans SB3
MFAQNPVFIPGPTNMPEVLRRAADMPTLDHRSPLFAQILHPALAGVKGVLKSQDAEVFVFPSTATGGWETALSNTLSAGDAVLAARHGMFSHRWIDMTRRHGLDVRVIEAPWGEGLPADRFAEALAADTAHRIRAVLVTHNETATGVRSDVAAVRRALDASGHPALLLVDGVSSIASMDFRMDEWGVDVAVTGSQKGFMLPAGLAIVAFSPRAMAATATATLPRTYFDVRDMAKGYPNGAYPYTPAVGLLNGLKLSTELLLAEGLDNVFARHRRIADGIRAAVAAWGLELCAARPDLYSDTVSAICAPEGFDATRIVTHAARHYDVAFGVGLGEVAGKVFRIGHLGSLTDVMALSGIAAAEMAMADLGLRIELGSGVAAAQAVYRRAPAAGLRAAA

SEQ ID NO: 332 - protein, 396 aa, Pelagimonas varians DSM 23678
MSFQNPVFIPGPTNIPEALRKACDMPTIDHRSPLFGQILHPARRGVRQVLKSDTAKVFIFPSTGTGGWETALTNCLSAGDKVLAARNGMFSHRWIDMCQRHGLDVQIVETPWGDGLPADRYEEILTADTSHQIKVVLATHNETATGVKSDIAAVRKALDAAGHPALLFVDGVSSIGSMDFRFDDWSVDVAVAGSQKGFMLPAGLAIVGFSAKAMEATKTAALPRTFFDVHDMAKGYDNNAYPYTPAVGLLNGLNEACTMLLAEGLENVFARHTRIATGVRAAVDAWGLNLCAASPDVYSDTVSAICTPDGFNATDIVTHAAETYGVAFGVGLGEVAGKVFRIGHLGSLTDVMTLSGIATAEMCMVDLGLDIKLGSGVAAAQEFYRLNPAARLQNAA

SEQ ID NO: 333 - protein, 396 aa, Thalassobius mediterraneus 5120
MSFQNPVFIPGPTNMPEVLRKAVDMPTLDHRSPLFGQILHPAIAGVKQVLKSKSAEVFIFPASGTGGWETALTNTLSAGDKILAARNGMFSHRWIDMCQRHDLDVTIVETPWGEGLPADRYEEILTADTNHEIQAVLATHNETATGVKSDIAAVRRALDAAGHPALLFVDGVSSIASMDFRMEEWGVDVAVTGSQKGFMLPAGLAIVGFSPKAMEVIETAKLPRTFFDVRDMAAGYANNAYPYTPAVGLLNGLKLSCDMLLGEGLENVFARHNRIASGVRAAVGAWGLDLCAASPDVYSDSVSAIRTPEGFNATDIVTLAAEKYGVAFGVGLGEVAGKVFRIGHLGSLTDVMALSGIATAEMCMVDLGLDITLGSGVAAAQDYYRNQDAAPAKAAA

SEQ ID NO: 334 - protein, 396 aa, Jannaschia sp. CCS1
MSFQNPVFIPGPTNMPERIRTACDMPTIDHRSPTFGRILHPCLENVRKILKSDNAHIFIFPSTGTGGWETALTNTLSPGDKVLAARNGMFSHRWIDMCQRHQLDVDIVETPWGAGLPAERYAEILAADTAHEIKVVLATHNETATGVKSDIAAVRRALDDAGHPALLFVDGVSSIASMDFRFDEWGVDIAVTGSQKGFMLPAGLAIVGFSDKAKAASETATLPRTFFDIKDMAGGYAANAFPYTPPVGLMRGLKLATDLLLEEGLENVFARHHRIAEGVRRAVDAWGLELCAQSADVQSDTVSAIKTPEGFDATDIVTRAAETYGVAFGVGLGEVAGKVFRIGHLGSLTDVMALSGLATAEMCMVDLGLDIKLGSGVAAAQEYYRTNPAQSALPVD

SEQ ID NO: 335 - protein, 398 aa, Mesorhizobium sp. BNC1
MVVSTQNPIFIPGPTNIPEVLRKAVDMPTIDHRSPLFGKILHPAIEGVKKVLKTKQAKLFVFPSTGTGGWETAITNVLSPGDKVLATRNGMFSHRWIDMCQRHGLDVIVVPQDWGESVPADRFEEILAADKAHKIKAVLATHNETATGVRSDIAAVRHAMDAAAHPALLLVDGVSSIASMDFRMDEWGVDIAVTGSQKGFMLPPGLAILGFSPKALEAVEAAKLPRTFFDIRDMARSYANNGYPYTPPVGLLNGLKIASEMLLEEGMENVFARHHRIAEGIRQAVAAWGLRLCAVRPELYSDTVSAIRVPDGFDGNRVVAHALNVYGVAFGTGLGDVAGKVFRIGHLGSLTDVMALSGIATAEMVLVDLGLPIKLGSGVAAAQEHYRLSAGNAQKRAA

SEQ ID NO: 336 - protein, 397 aa, Roseovarius sp. TM1035
MSDQNPVFIPGPTNIPDRLRRAMQVQTQDHRSPAFVNTLAPVLKGCKTVFGTAKGEIITFPASGTGGWEAAITNTLSPGDKVLVARYGMFSHRWIDMCQRHGLDVQIIECPWGSGAPADRFQEALSADKDHSIKAVLVTHNETATGVRSDIAAVRGAMKASNHPALLMVDCVSSLGSMPFEMDTWGVDIAVSGSQKGFMLNTGMAILAVSPKALAMMETAKLPRTFFDFRDMMGANAKGGFPYTPPLQLIYGMAESLNMLFEEGLDNVYARHTRIAEGVRRAVAAWGLKLVAQTPDLYSDTVSAVFVPEGFDSNRLTERVFGTYGMSFGVGLGEMNGRAFRIGHLGSLTESMMLSGLATLEMAMADLNYPVKMGSGVIAAQEYYRATAKPVLAEKAA

SEQ ID NO: 337 - protein, 396 aa, Methylobacterium radiotolerans JCM 2831 plasmid pMRAD01
MFAQNPVFIPGPTNMPEVLRRAADMPTLDHRSPLFAQILHPALAGVKTVLKSQDAEVFVFPSTATGGWETALSNTLSAGDAVLAARHGMFSHRWIDMTRRHGLDVRVIEAPWGEGLPADRFAEALAADTAHRIRAVLVTHNETATGVRSDVAAVRRALDASGHPALLLVDGVSSIASMDFRMDEWGVDVAVTGSQKGFMLPAGLAIVAFSPRAMAATATATLPRTYFDVRDMAKGYPNGAYPYTPAVGLLNGLKLSTELLLAEGLDNVFARHRRIADGIRAAVAAWGLELCAARPDLYSDTVSAICAPEGFDATRIVTHAARHYDVAFGVGLGEVAGKVFRIGHLGSLTDVMALSGIAAAEMAMADLGLRIELGSGVAAAQAVYRRAPAAGLRAAA

SEQ ID NO: 338 - protein, 395 aa, Rhizobium sp. NGR234
MSGYNHLFIPGPTNIPEQIRQAMNLPMEDMRSPRYPELTLPLFADVKKVFKNRNGRVFIYPSSGTGAWEAAMTNVLSPGDRVLMSRFGQFSHLWVDMAERLGLEVDCLDREWGTGVPVDLYTERLAADKAHRIKAVFVTHNETATGVTSDVAAVRAALDASGHPALLFVDGVSSIGSIDFRQDEWGVDCAVSGSQKGFMLPAGLGFLSVSQKALEAAKTARHMRCYFSFEDMIKTNDTGYFPYTPPTQLLHGLRAALDVIFEEGLENIFARHRHLADGVRAAVSAWGLKLCATEPKWYSDTVSAIRLPEGIDGVKVIRHAFDTYNTSLGSGLSKVAGKVFRIGHLGSLNEVMVLGALSAAELTLLDCGVKIEPGAGVGAAIRQFRAAATATAKAA

SEQ ID NO: 339 - protein, 396 aa, Rhizobium sp. NGR234 plasmid pNGR234b
MHQQNPVFIPGPTNMPEVLRKASDMPTIDHRSPMFGEILRPGLAGVKKVLKSEAASIFVFPATGTGGWETAITNTLSPGDRVLAARNGMFSHRWIDMCQRHGLNVEIILASWGSGAPADRYEEILAADKAHEIKAVLVTHNETATGVRSDIAAVRRAIDAARHPAMLFVDGVSSIASMDFRMDEWGVDIAVTGSQKGFMLPAGLAITAFSPKALAALETAKLPRTFFDVRDMSKSYENNAYPYTPAVGLLNGLKVSTEILLAEGLENVFARHKRIASGVRAAVRAWGLELCATSEDLYSDTVSAIRTPEGFDATSVVTHAAKKYDVAFGVGLGEVAGKVFRIGHLGSLTDVMALLGIATAEMVMADLGLAIKLGSGVAAAQEFYRSSHVPAGQGAA

SEQ ID NO: 340 - protein, 396 aa, Citreicella sp. SE45 genomic scaffold scf_1113211290443
MSFQNPVFIPGPTNIPESLRKACDMPTIDHRSPLFGQILHPAREGVRKVLKSDAAEVFIFPSTGTGGWETALSNTLSPGETVLAARNGMFSHRWIDMCQRHGLSVEIVETPWGEGLPAHRYAEILAADTQHRIKAVLATHNETATGVRSDIAAVRRALDDAGHPALLFVDGVSSIASMDFRFDEWGVDCAVAGSQKGFMLPPGLAIVGFSDKAMAATQTARLPRTFFDVQDMAKGYANNAYPYTPAVGLLNGLNEACRMLLDEGLENVFARHHRIAEGVRCAVRAWGLELCAASPEVYSDTVSAIRTPDGFNATDIVSHAAQTYGVAFGTGLGEVAGKVFRIGHLGSLTDVMTLSGLATAEMCMKDLGLDITLGSGVAAAQEFYRATPALARKAAA

SEQ ID NO: 341 - protein, 396 aa, pCaer_C109
MSFQNPVFIPGPTNMPEALRKAVDMPTLDHRSPLFGQILHPALAGVKKVLKSETAEIFVFPSTGTGGWETAITNTLNAGDKILAARNGMFSHRWIDMCQRHGLDVQVVETPWGEGLPADRYEEILTADTSHQIKVVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLERVFARHHRIAEGVRAAVRAWGLELCAVSPDVYSDSVSAIRTPDGFDANKFVSLAAEKYGVAFGTGLGEVAGKVFRIGHLGSLTDVMALSGIATAEMVMADLGLDIPLGSGVAAAQDYYRGNTASSAKAAA

SEQ ID NO: 342 - protein, 396 aa, Ensifer fredii USDA257
MSGYNHLFIPGPTNIPEQVRQAMNLPMEDMRSPRYPELTLPLFADVKKVFKNHSGRVFIYPSSGTGAWEAAMTNVLSPGDRVLMSRFGQFSHLWVDMAERLRFEVDCIDREWGTGVPVELYAERLAADKAHKIKAVFVTHNETATGVTSDVAAVRASLDACGHPALLFVDGVSSIGSIDFRQDEWGVDCAVSGSQKGFMLPAGLGFLSVSAKALEAARTARHMRCYFSFDDMIKTNDAGYFPYTPPTQLLRGLRASLDLIFEEGLENIFARHHYLANGVRAAVSAWDLQLCATEPKWHSDTVSAIRLPEGVDGVEVIRHAYRTYNTSLGSGLSKVAGKIFRIGHLGSLNEVMVLGALSAAELTLLDCGVKIEPGSGSGAAIKQFRSAATASTAKAA

SEQ ID NO: 343 - protein, 396 aa, Ensifer fredii USDA257
MYLQNPVFIPGPTNMPEVLRKASDMPTIDHRSPLFGEILRPALAGVKKVVRSQSASIFVFPATGTGGWETAITNTLSPGDRVLVARYGMFSHRWIDMCQRHGLDVSVIETPWGSGAPVDRYEEMLTADKAHQIKAVLVTHNETATGVKSDIAALRRALDAARHPAMLFVDGVSSIASMEFRMDDWGVDVAVTGSQKGFMLPAGLAITAFSPKALAAIETAKLPRTFFDVRDMSKSYENNAYPYTPVVGLLNGLKVSTEMLLAEGLENVFARHNRIATGIRAAVRAWGLELCAMSEDLYSDTVSAIRTPDGFDATSVVTHAAKKYDVAFGVGLGEVAGKVFRIGHLGSLTDVMALSGIATAEMVMADLGLAIKLGSGVAAAQDYYRNNQVSAGNGAA

SEQ ID NO: 344 - protein, 396 aa, Paracoccus pantotrophus J46 ICCP
MTSQNPIFIPGPTNIPEEMRKAVDMPTIDHRSPVFGRMLHPALEGVKKVLKTTQAQVFLFPSTGTGGWETAITNTLSPGDKVLAARNGMFSHRWIDMCQRHGLDVTFVETPWGEGIPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMAAVESARLPRTFFDIRDMATGYARNGYPYTPPVGLINGLNASCERILAEGLENVFARHHRIASGVRAAVEAWGLKLCAVRPELYSDSVSAIRVPEGFDANLIVSHALETYDMAFGTGLGQVAGKVFRIGHLGSLTDAMALSGIATAEMVMADLGLPIKLGSGVAAAQEHYRQTTAAAQKKAA

SEQ ID NO: 345 - protein, 396 aa, Paracoccus sp. J4
MTSQNPIFIPGPTNIPEEMRKAVDMPTIDHRSPVFGRMLHPALEGVKKVLKTETALVFLFPSTGTGGWETAITNTLSPGDKVLAARNGMFSHRWIDMCQRHGLDVTYVETPWGEGIPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVESARLPRTFFDIRDMATGYARNGYPYTPPVGLINGLNLSCERLLAEGLENVFARHRRIAGGVRAAVEAWGLKLCAVRPELYSDSVSAIRVPEGFDANLIVSHALETYDMAFGTGLGQVAGKVFRIGHLGSLTDAMALSGIATAEMVMADLGLPIRLGSGVAAAQEHYRQTTAAAQKKAA

SEQ ID NO: 346 - protein, 396 aa, Paracoccus sp. N5
MTSQNPIFIPGPTNIPEEMRKAVDMPTIDHRSPVFGRMLHPALEGVKKVLKTESAQVFLFPSTGTGGWETAISNTLSPGDKVLAARNGMFSHRWIDMCQRHSLDVTYVETPWGEGIPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVETARLPRTFFDIRDMATGYARNGYPYTPPVGLINGLNVACERLLSEGLENVFARHNRIASGVRAAVEAWGLKLCAVRPELYSDSVSAIRVPEGFDANRIVSHALETYDMAFGTGLGEVAGKVFRIGHLGSLTDAMALSGIATAEMVMADLGLPVKLGSGVAAAQEHYRQSTAAALKKAA

SEQ ID NO: 347 - protein, 397 aa, Roseovarius mucosus DSM 17069
MSDQNPVFIPGPTNIPDRLRRAMQVQTQDHRSPAFVNTLAPVLKGCKTVFGTAKGEIITFPASGTGGWEAAITNTLSPGDKVLVARYGMFSHRWIDMCERHGLDVQIIECPWGSGAPADRFQEALTADKGHSIKAVLVTHNETATGVVSNIAAVRAAMKAAKHPALLMVDCVSSLGSMPFEMDTWGVDIAVSGSQKGFMLNTGMAILAVSPKALAMMETAKLPRTFFDFRDMMGANAKGGFPYTPPLQLIYGMAESLNMLFEEGLDNVYARHTRIAEGVRLAVAAWGLKLVAQTPDLYSDTVSAVFVPEGFDSNRLTERVFSTYGMSFGVGLGEMNGRAFRIGHLGSLTESMMLSGLATLEMAMADLNYPVKMGSGVIAAQEYYRSTAKPVLAEKAA

SEQ ID NO: 348 - protein, 389 aa, Marinobacter sp. BSs20148
MSDQNPIFIPGPTNIPDRLRFAMNVQSSDHRSPGFVETLSPLLQDCKKVFNTQSGEVILFPASGTGGWEAAICNTLSPGDKVLIARYGMFSRRWIEMCQRHGLDVQIIECPWGSGAPANEFKRALSADTQHKIKAVLVVHNETATGVTSDIDAVRQAMDSCSHPALLLVDCVSSLASMPFEMDNWGVDIAVSGSQKGFMLITGMAILAVSQKALAAMETAKLSCAFFDFRAMMTANAQGGFPYTPPLQLIYGLKESLKMLFEEGLDNVYARHFRLAEGVRQAAHAWGMALCAQSPDLYSNTVTAIYVPEGFDSNELTDHTFAKYGVSFGIGLGEMHGKAFRIGHLGSLTDSMVLSGLATIEMAMADLDYPIELGSGVRAAQNHFRATTA

SEQ ID NO: 349 - protein, 397 aa, Ensifer sp. USDA 6670
MYLQNPVFIPGPTNMPEVLRKASDMPTIDHRSPLFGEILRPALAGVKKVVKSQSASIFVFPATGTGGWETAITNTLSPGDRVLVARYGMFSHRWIDMCQRHGLDVSVIETPWGSGAPVDRYEEMLTADKAHQIKAVLVTHNETATGVKSDIAAVRSALDAARHPAMLFVDGVSSIASMEFRMDDWGVDVAVTGSQKGFMLPAGLAITAFSPKALAALETAKLPRTFFDVRDMSKSYENNAYPYTPAVGLLNGLKVSTEMLLAEGLENVFARHNRIATGIRAAVRAWGLELCAMSEDLYSDTVSAIRTPDGFDATSVVTHAAKKYDVAFGVGLGEVAGKVFRIGHLGSLTDVMALSGIATAEMVMADLGLSIKLGSGVAAAQDYYRNNQVSAGRGERL

SEQ ID NO: 350 - protein, 396 aa, Rhizobium etli CNPAF512
MYTQNPVFIPGPTNMPEVLRRAADLPTIDHRSAAFADILQPALAGVRKVVKSENAEIVVFPATGSGGWEAAITNLLSPGDKVLAARHGMFSHRWIDMCQRHGLQVDAVHSSWKQPLPLAEYEKRLFADKGHDIKAVLVTHNETATGVKSDVGAVRRLLDEARHPALLLVDGVSSIASMDFRMDEWKVDAAITGSQKGFMLPVGLAILALSPKAMQAAQSAKLHRAFFDIREMAKTYPSSGYPYTPSIGLLNGLKVSTELLLGEGLDNVFKRHARIASGVRAAVSAWGLRLYAQEASSYSDTVSAVETPEGFDATSIVTHAAQKYAVAFGAGLGDVAGRVFRIGHLGSMSDVMALSGIAAAEMAMADLGLPIRLGSGVAAAQEIYRNTAATPARNAA

SEQ ID NO: 351 - protein, 396 aa, Sulfitobacter sp. 20_GPM-1509m
MSFQNPVFIPGPTNIPENLRKACDMPTIDHRSPLFGQILHPARAGVRKVLKSTSAEVFIFPSTGTGGWETALTNTLSAGDTVLAARNGMFSQRWIDMCQRHGLNVNVVETPWGQGVPADRYAEILAADTGHQIKAVLATHNETATGVRSNIAAVRHALDTAGHPAMLFVDGVSSIGSMEFRFDDWGVDVAVTGSQKGFMLPAGLGIVGFSAKAMEATKSAKLPRTFFDVHDMAKGYANNAYPYTPAVGLLNGLNTACGMLLSEGLDAVFARHHRIAEGVRAAVGAWGLELCAASPDLYSDTVSAIRTPEGFNATDIVTHAAEAYGVAFGVGLGEVAGKVFRIGHLGSLTDVMMLSGIATAEMCMADLGLDITLGSGVAAAQDYYRANRTVRQQDAA

SEQ ID NO: 352 - protein, 395 aa, Maribius sp. MOLA 401
MSFQNPVFIPGPTNMPEAIRKACDMPTIDHRSPLFGGILHPCLDGVRKVLKSDAAHVFIFPATGTGGWETALTNTLSPGDRVLAARNGMFSHRWIDMCQRHKLDVDVVETPWGHGVPADRYEEILTADTGHGIKAVLATHNETATGVKSDIAAVRRALDAAGHPALLLVDGVSSIGSMDFRFDDWGVDVAVTGSQKGFMLPAGLAIAGFSDKAMEATATAALPRTFFDVKDMQKGYDSDAFPYTPPVGLMNGLRLSLDMLLDEGLENVFARHHRIAEGVRRAVGAWGLELCAASPELYSDSVSAIRTPEGFNATDIVTLAARDYGMAFGVGLGEVAGKVFRIGHLGMLTDAMMLSGLGVAEMAMVDLGLDITLGSGVAAAQEHYRHGNTARKAAA

SEQ ID NO: 353 - protein, 393 aa, Amphritea atlantica DSM 18887
MTDQNPVFIPGPTNIPDRLRNAMHLQTRDHRAPDFVETFAPVLRDCKRVFGTETGEVITFPSSGTGGWEASICNTLSAGDKVLIARYGMFSHRWIDLCQRHNLDVQVIECAWGSGAPADKFAEVLSADNGHEIKAVLVTHNETATGVKSDIAAVRQAMDASGHPALLFVDCVSSLASMPFEMDAWGVDIAVSGSQKGFMLNTGMAILGVSQKALAAMETATLTRTFFDFRDMMAANANGGFPYTPPLQLIYGMKESLAMLFEEGLENVYARHHRLAEGVRKAVDAWGLKLCAQSPELYSDTVSAIYVPEGFDSNQLTEHAFNAYGVSFGIGLGEMNGKAFRIGHLGSLTDVMVLSGLATIEMAMADLNYPITLGSGVAAAQEYFRKTASKNCA

SEQ ID NO: 354 - protein, 396 aa, Rhodobacteraceae sp. HL-91
MSLQNPVFIPGPTNMPESLRKACDMPTIDHRSPAFAAVFQPAVAGVKEVLGMEAGEVLLLPATGTGGWEAAISNALSPGDKVLAARHGMFSHRWIDLCQRHGLDVQIIEAPWGEGCPTDAMGEALAADTDHSIKAVLATHNETATGVRSDIAGLRAAMDKAGHPALLLVDGVSSIASMPFEMDAWGVDIAVAGSQKGFMLPAGLAILGVSSKALAARDSATLPRTYFDFGDMLKGYAAGGYPFTPPVGLINGLAASIAMLQAEGLDNVYARHHRLAEATRRAVGGWGLKVCAARPDLYSDTVTGVMAPEGFNGTDVVTLAASKYGVAFGVGLGEVAGKLFRIGHLGSLTDVMLLSGLATAEMCMADLGWPVKLGSGVAAAQEYLRGTTAESIAKAA

SEQ ID NO: 355 - protein, 396 aa, Methylobacterium sp. UNCCL143
MFAQNPVFIPGPTNMPEVLRRAADMPTLDHRSPLFAQILHPALAGVKKVLKSEDAEVFIFPSTATGGWETALSNTLSAGDTVLAARHGMFSHRWIDMTRRHGLDVRMIEAPWGEGLPADRFAEALAADKAHRIRAVLVTHNETATGVRSDVAAVRRALDASNHPALLLVDGVSSIASMDFRMDEWGVDVAVTGSQKGFMLPAGLAIVAFSPKAMAATATATLPRTYFDIRDMAKGYPNGAYPYTPAVGLLNGLKLSTELLLAEGLETVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMADLGLRIALGSGVAAAQAVYRRAPAAALRAAA

SEQ ID NO: 356 - protein, 396 aa, Aquisalimonas asiatica CGMCC 1.6291
MENQNPVFIPGPTNIPERLRKAMSVPTWDHRSPEFGRMFVPLLQDLKQPFGTTRGDVAVFTASGTGGWETAITNTLSPGDTVLAARYGMFSHRWIDLCERHGLDVKVIDCGWGEGAPIAAYRDALAADTDHRIKAVLSVHNETATGVRSDVGAVREAMDAADHPAMLFVDGVSSIGSMEFRMDDWGVDMAVAGSQKGFMLATGLAIVAASPKAQAAMETAQLPRCYFDLRDMLAAGGKGSYPYTPAIGLIEGLRESVNMLLAEGLDNVHARHFRIAEGVRRAVAAWGMEVCARHPELNSDTVTAIMVPDGFDSTELVNYANETYGVSFGIGLGQVAGQLFRIGHLGQMSDVMALSGIATAEMAMKDLGYPIELGSGVAAAQEYYRANSAVAQRKTA

SEQ ID NO: 357 - protein, 396 aa, Roseovarius lutimaris DSM 28463
MSDQNPVFIPGPTNMPDRLRRAMQVQTQDHRSPAFVETLTPVLEGCKTVFRTTTGTIITFPASGTGGWEAAISNTLSPGDTVLVARYGMFSHRWIDMCQRHGLNVQIIECPWGSGAPADKFQEALSADADHAIKAVLVTHNETATGVKSDIAAVRRAMNTANHPAMMFVDCVSSLGSMEFRMDDWGVDIAVSGSQKGFMLATGMAILAVSPKAIAAMDTAKLPRTFFDFRDMMSANAGGGYPYTPPLQLIYGMAESLKMLFEEGLENVYARHHRLATGVRRAVDAWGLRLVAQSPELYSDTVSAVFVPEGFDSNALIEHVFATYGVSFGIGMGEMNGRAFRIGHLGSLTDTMVLSGLATIEMAMADLGYPVKLGSGVVAAQEYFRATTKPALAKAA

SEQ ID NO: 358 - protein, 396 aa, Halocynthiibacter sp. PAMC 20958
MSFQNPVFIPGPTNMPEAVRQACYMPTIDHRSPTFGKILHPCLEGVQQVLKSDTAKVFIFPSTGTGGWETALSNTLSKGDKVLAARNGMFSHRWIDMCQRHGLDVQIVETAWGEGLPADRYEEILRADKSHDIKVVLATHNETATGVKSDIAAVRRALDAAGHPALLFVDGVSSIASMDFRFDEWGVDVAVTGSQKGFMLPAGLAILGFSDKSIAASKNAGLPRTFFDIKDMQNGYNANAFPYTPPVGLMNGLKLSLEMLLGEGLENVFARHHRIAEGVRAAVSAWGLDLCAVSPDVYSDTVSAIRTPEGFNATDIVTLAAEKYDVAFGVGLGEVAGKVFRIGHLGSLTDVMTLSGLATAEMCMADLGLDITLGSGVAAAQQYYRSNSALTQRIAA

SEQ ID NO: 359 - protein, 396 aa, Leisingera sp. ANG-S3; identical to SEQ ID NO: 322

SEQ ID NO: 360 - protein, 395 aa, Paracoccus saliphilus DSM 18447
MTSQNPVFIPGPTNIPEILRKAVDMPTIDHRSPVFGKILHPALEGVKKVLKTAEGQVFVFPSTGTGGWETAISNTLSPGDKVLATRNGMFSHRWIDMCQRHGLDVEVVDQKWGEGVPADRFEEILTADKAHQIKAVLATHNETATGVKSDIAAVRRAMDAAGHPALLFVDGVSSIGSMDFRMDEWGVDIAVTGSQKGFMLPPGLAIIGFSPKAMAALETAKLPRTFFDIRDMAKGYAANGFPYTPPVGLINGLNLSTQMLLEEGLENVFARHHRIAEGVRKAVAAWGMELCAARPELYSDSVSAIRVPEGFDANKVVGHALEAYGVAFGTGLGDVAGKVFRIGHLGSLTDVMALSGIATAEMVMADLGLPVALGSGVAAAQEHYRQSAAALEKAA

SEQ ID NO: 361 - protein, 392 aa, Rhodovulum sulfidophilum DSM 1374
MHASNPIFLPGPTNLPEPLRRACDIPTMDHRSAAFGPILAAAKDGVARILGLSGGEVALFPATGTGGWEAAVTNALRPGDKVLAARHGMFSRKWIDLCQRHGLEVEIVERPWGEGVPVEEFAAALAADGGHQIRAVLVTHNETATGVTSDVAAVRAAMDATGHPALLMVDGVSSIGSIEFRMDDWGVDLAVAGSQKGFMLPAGLAIIGISAKARQAMETAGLPRCFFDIRDMADGNYPYTPPVGLINGLAVSTGLLLEEGMENVRARHHRIAEGVRRAVAAWDMTTCAAAPELCSDTVTAIVTPEGFDAGRIVRHAAEAYGVAFGGGLGEVAGKVFRIGHLGLMSDVMALSGIATAEMAMVDLGLPVRLGSGVAAAQEHYRNSRTAPVQAAA

SEQ ID NO: 362 - protein, 392 aa, Litoreibacter ascidiaceicola DSM 100566
MSFQNPVFIPGPTNMPEAVRQACYMPTIDHRSPTFGKILHPCLEGVRKVLKSKDAKIFIFPSTGTGGWETALSNTLSKGDKVLAARNGMFSHRWIDMCQRHGLDVHVVETPWGEGIPADKYEEILKADTKHEIKVVLATHNETATGVKSDIAAVRKALDAAGHPAMLFVDGVSSIASMDFRFDEWGVDVAITGSQKGFMLPAGLAIIGFSGKAIAAAEKSDLPTTFFDIKDMQKGYDANAFPYTPPVGLMNGLKLSLDMLLEEGLENVFARHHRIAEGVRKAVSAWGLELCAASPDLYSDTVSAIRTPEGFNATDIVTHAADKYDVAFGVGLGEVAGKVFRIGHLGSLTDVMTLSGLATAEMCMVDLGLDVKLGSGVAAAQEYYRTNPVAGK

SEQ ID NO: 363 - protein, 396 aa, Roseovarius marisflavi DSM 29327
MSDQNPVFIPGPTNMPDRLRRAMQVQTQDHRSPAFVETLTPVLEGCKTVFGTANGTIITFPASGTGGWEAAISNTLSPGDKVLVARYGMFSHRWIDMCQRHGLDVQIIECPWGSGAPADKFQEALSADTDHTIKAVLVTHNETATGVKSDIAAVRRAMNTANHPAMMFVDCVSSLGSMDFRMDGWGVDIAVSGSQKGFMLATGMAILAVSPKAIAAMETAKLPRTFFDFRDMMGANAAGGYPYTPPLQLIYGMAESLKMLFEEGLDNVYARHHRLATGVRRAVDAWGLKLVAQSPDLYSDTVSAVFVPEGFDSNALIEHVFATYGVSFGIGMGEMNGRAFRIGHLGSLTDTMVLSGLATIEMAMADLDYPIKLGSGVVAAQEYYRATTKPALAKAA

SEQ ID NO: 364 - protein, 399 aa, Rhodovulum sp. ES.010
MKTGCTHLFIPGPTNIPEPVRQAMNVPMQDMRAPDFGDLTLGLFSDLKRVLRTESGRVFLFPGSGTGAWEAAITNTLNPGDKVLMSRFGQFSHLWVEMAERLGLDVEVIDVPWGGGCPVKEYARRLGADKHGEIKAVFVTHNETATGVTSDVAGVRRALDESFHDALLFVDGVSSIASIDFRMDDWGVDLAVTGSQKGLMLPAGLGVLGVSEKAMEASKTATMRRAYFEFSDMVKLNETGYFPYTPPTQLFHGLRRSLDRIFDEGLDNVIARHHRLAEGVRRGVHAWGMELVAEHPSLWSDTVSAIRVPAEVDARDVIRIGYERYNISFGTGLAQLAGKVFRIGHLGDLNEGMCLTALSLAELSLAAAGARVEFGSGVAAAQDWYAKNSAAPDLKIAAE

SEQ ID NO: 365 - protein, 392 aa, Rhodovulum sp. ES.010
MSSQNPVFIPGPTNIPESIRRACDIPTMDHRSAAFPPLFERAKSGVRQMLKMDEGEVILFPASGTGGWEAAVTNTLSPGDKVLAAQHGMFSLKWIDLCERHGLDVEVVKCPWGEGAPVERFAEILAADTSHEIKAVLVTHNETATGVTSDVAAVRAAMDDAGHPALLMVDGVSSIASIDFRMTEWGVDLAVTGSQKGFMLPVGLAIVGVSPKALTAMETAKLSRCFFDFRDMLKLGTPYTPAVGLINGLGAACDMLLEEGLKNVFARHHRIAEGVRAAVSAWGMRPCADRPALYSDTVTAIVLPEGVDGNALVRHAAEAYHVAFGAGLGEVAGKVFRIGHLGQLTDVMALSGIATAEMAMADMGVAVTLGSGVAAAQDYYRTNKAAPVKAAA

SEQ ID NO: 366 - protein, 396 aa, Ruegeria sp. P4
MSFQNPVFIPGPTNIPESLRKACDMPTIDHRSPLFGQILHPARDGVRKVLKSETAEVFIFPSSGTGGWETALSNTLSAGDTVLAARNGMFSHRWIDMCQRHGLEVQIVETPWGAGLPADRYEEILNADKAHKIKAVLATHNETATGVKSDIAAVRRALDAAGHPALLFVDGVSSIASMDFRMDEWGVDVAVTGSQKGFMLSAGLAIVGFSPKAMEATKTAQLPRTFFDVHDMAKGYANNAYPYTPAVGLMNGLNESCKMLLAEGLENVFARHHRIAEGVRAAVGAWGLELCAASPEVYSDTVSAIRTPEGFNATDIVTHAADKYGVAFGVGLGEVAGKVFRIGHLGSLTDVMALSGIATAEMCMVDLGLDIQLGSGVAAAQDYYRGNAASAQQDAA

SEQ ID NO: 367 - protein, 395 aa, Jannaschia rubra CECT 5088
MNFQNPVFIPGPTNMPEAIRQACYMPTIDHRSPVFGKILNPCLEGVRKVLKSDSARIFIFPSTGTGGWETALTNTLSPGDGILAARNGMFSHRWIDMCQRHGLDVTVVETPWGEGLPAENYEEVLKADKDHRIKAVLATHNETATGVKSDIAAVRRALDAARHPALLFVDGVSSIGSMDFRFDDWGVDVAVTGSQKGFMLPAGLAIVGFSDKAMKATETAKLPRTFFDVRDMGKGYDNNAFPYTPPVGLMNGLKLSLDMLLDEGLENVFARHHRIAEGVRRAVRAWGLELCAVSPDLYSDTVSAIRTPEGFNATDIVTVAARDYDMAFGVGLGEVAGKVFRIGHLGSLTDAMMLSGLGVAEMVMVDLGLDVKLGSGVSAAQEFYRHGGTARKAAA

SEQ ID NO: 368 - protein, 396 aa, Ruegeria atlantica CECT 4292
MSNQNPVFIPGPTNIPDRLRLAMQVQTQDHRAPDFVETFAPVLEDTKKVFGTTTGQIVTFPSSGTGGWEAAITNTLSPGDKVLVARYGVFSHRWVDLCERHGLDVQIVECPWGTGAPADQFQAALANDTAHEIRAVLVTHNETATGVRSDIAAVRQAMDSENHPSMLFVDCVSSLASMPFDFDAWGVDIAVSGSQKGFMLATGMAILCVSPKAQDAMKSAKLPRTFFDFDDMMAANASGGFPYTPPLQLIYGMRESLKMLFEEGLENVYARHFRLAEGVRRAVDAWGLKLVAQSPDLYSDTVSAIYVPNGYDSNTLTDHAFNAYGVSFGIGLGQLNGKTFRIGHLGSLTDVMVLSGLGTIEMAMADLNYPITLGSGVAAAQDFYRTGPSDRAQAAA

SEQ ID NO: 369 - protein, 396 aa, Rhizobium sp. N324
MYGQNPVFIPGPTNMPEILRKAADMPTMDHRSSMFGEILHPALAGVKQVLKTETASVFIFPATGSGGWETAITNTLSPGDRVLAGRHGMFSHKWIDMCRRYQLKVDAIESSWHDGVPLAQYEELLNGDKAHEIKAVLVTHNETATGVKSDVAAVRRLLNAANHPALLLVDGVSSIASMDFRMDEWGVDVAVTGSQKGFMLPVGLAITAFSAKAMAALETAKFPRAFFDVRDMAKGYSTNGYPYTPSVGLLNGLKVSTELLLQEGLENVFARHRRIASGVRAAVRAWRLELYAAREELYSDTVTAVQTPAGFDASRFVTHAATKYDVAFGAGLGDVAGKVFRIGHVGSMTDVMALSGIATAEMVMVDLGLNIKLGSGVAAAQAIYRNSQSSAFYMVA

SEQ ID NO: 370 - protein, 396 aa, Rhizobium sp. N941; identical to SEQ ID NO: 369

SEQ ID NO: 371 - protein, 396 aa, Sinorhizobium americanum CFNEI 73
MYLQNPVFIPGPTNMPEVLRKASDMPTIDHRSPLFGEILRPALAGVKKIVKSDAASIFVFPATGTGGWETAITNTLSPGDRVLVARYGMFSHRWIDMCQRHGLDVSVIETSWGSGAPVDRYEEMLTADKAHQIKAVLVTHNETATGVKSDIAAVRRALDATRHPAMLFVDGVSSIASMEFRMDDWGVDVAVTGSQKGFMLPAGLAITAFSPKALAALETAKLPRTFFDIRDMSKSYENNAYPYTPAVGLLNGLKVSTEMLLAEGLENVFARHKRIATGVRAAVRAWGLELCARSEDLYSDTVSTIRTPDGFDATSVVTHAAKKYDVAFGVGLGEVAGKVFRIGHLGSLTDVMALSGIATAEMVMADLGLAIKLGSGVAAAQEYYRSNQVSAGRGAA

SEQ ID NO: 372 - protein, 395 aa, Sinorhizobium americanum CFNEI 73
MSGYNHLFIPGPTNIPERVRQAMNLPMEDMRSPRYPELTLPLFADIKEVFKNKTGRVFIYPSSGTGAWEAAMTNVLSPGDRVLMSRFGQFSHLWVDMAERLGFEVDCLDREWGTGVPVELYAERLAADKAHEIKAVFVTHNETATGVTSDVAAVRAALDACGHPALLFVDGVSSIGSIDFRQDEWGVDCAVSGSQKGFMMPAGLGFLSVSQKALEAARTARHMRCYFSFEDMIKTNDTGYFPYTPPTQLLRGLRAALDLIFEEGLETIFARHHHLANGVRAAVSAWGLKLCATEPKWHSDTVSAIRLPEGIDGVEVIRHAYQTYNTSLGSGLSKVAGKVFRIGHLGSLNEVMVLGALSAAELTLLDCGVKIEPGAGVGAAISQFRSAAVSSAKAA

SEQ ID NO: 373 - protein, 398 aa, Puniceibacterium sediminis DSM 29052
MAGYNHLYIPGPTNVPEEVRMAMNVCMQDMRAPDFPNFTKPLFAKVQKVFKNTTGRVFLYPSSGTGAWEAAIQNTLSPGDKVLMSRFGQFSHLWVDMAQRLGLDVEVIECEWGEGVPVEKYATRLKADPGHEIKAVFATHNETATGVSSDIKGVRAALDAANHPALLMVDGVSSIGSIEFDQDAWGVDCAVSGSQKGFMLPAGIGILSVSKWALEAHKHAEYPRTFFSFEDMIATNDQGYFPYTPATQLLRGLDVACDMIHAEGLENIWARHHRLASGVRAAVDAWGLKLCAKEAKWHSNTVSAILVPDGVDARDVIATGYSKYNTSFGTGLSKVMGRVFRIGHLGWLNEGMVSTALSVAEMSMIDVGMNIKAGSGVGAAIDYFTSTAAKSGKAIAAE

SEQ ID NO: 374 - protein, 396 aa, Puniceibacterium sediminis DSM 29052
MSIQNPVFIPGPTNIPESVRKACDMPTIDHRSPLFATILHPAIDGCRKVLKTTEGELFIFPASGTGGWEASLTNTLNPGDTILAARNGMFSHKWIDMCHRFGLNVIQVDVPWGEGLPVPKFEEILRADPDGRIKAVLATHNETATGVVSDVAGLRRAMDAAGHGALLMVDGVSSIGSMNFEFDNWGVDVAVTGSQKGFMLPAGLAITCFSPKAIAASKTATLPRTFWSIDDMRNGYAANAYPYTPSVGLLNGLKHTTEMLLAEGLDNVFARHARIADGVRAAVRAWGMTPCAVSPDLYSNTVTAICTPEGFNASTIVERASLQYGMAFGTGLGDVAGKVFRIGHLGMLTDAMALSGIATAEMVMVDLGLPVTLGSGVAAAQEIYRKGGKIQKEQAA

SEQ ID NO: 375 - protein, 396 aa, Hyphomicrobium sulfonivorans WDL6
MSVQNPIFIPGPTNIPEVLRKAVDMPTIDHRSSLFGQILRPAIDGAKKVFKTTDGQLFIFPSTGTGGWEIAITNVLSPGDKVLATCNGMFSQRWIDMCRRHQLDVTMIQQAWGDGISAERVEKILAADKHHRISVVLATHNETATGVKSDIAALRRSLNATKHPALLFVDGVSSIGSMDFRMDEWGVDVAVSGSQKGFMLPPGLAIVGFSARALEATENARLPRTFFDIRDMAKSNALNGFPYTPPVGLLNGLKLSTEMLLEEGLDNVFARHHRIAEGVRAAISAWGMQLCALRPELYSDTVSAICVPDGFDANKIVARALNAYGVAFGTGIGAVAGKVFRIGHLGSLTEAMALSGIATAEMTMVDLGLPITLGAGTAAAQQHFRLSIESTQRKAA

SEQ ID NO: 376 - protein, 397 aa, Marivita geojedonensis DSM 29432
MSFQNPVFIPGPTNIPESLRKACDMPTIDHRSPLFGQILHPARKAVQQILKSTSAEVFIFPASGTGGWETALTNTLSAGDTVLVARNGMFSHRWIDMCERFGLDVIIVDVAWGNGIPADRYEEILTKDTAHRIKAVLATHNETATGVKSDIAAVRRAMDAAKHPALLMVDGVSSIASMDFRFDEWGVDVAVTGSQKGFMLPAGLAIVGFSQKAMEATKTAGLFRTFFDVHDMMKGYANNAYPYTPAVGLMNGLNEACRMLQAEGLENVFARHIRIAEGVRAAVDAWGLKLCAETPDVYSDTVSAIRTPEGFNASDIVSHAATTYGVAFGTGLGDVAGKVFRIGHLGSLTDVMALSGIATAEMCMVDLGLDIKLGSGVAAAQDYYRQGSNIAQKVAAE

SEQ ID NO: 377 - protein, 392 aa, Marinobacterium mangrovicola DSM 27697
MSDQNPVFIPGPTNIPDRLRNAMHIQTRDHRAPDFVETFAPVLEDCKRVFGTETGQVITFPASGTGGWEASICNTLSAGDTVLVARYGMFSHRWIDLCQRHNLEVQVIDCEWGSGAPADLFEQALKADTDKTIKAVLVTHNETATGVKSDIAAVRRAMDAASHPAMLFVDCVSSLASMPFHMDDWGVDIAVSGSQKGFMLATGMAILGVSQKALAAMETATLPRTFFDFRDMMAANASGGFPYTPPLQLIYGMRESLKMLLEEGLDNVYARHFRLAEGVRKAVEAWGMKLCAQSPELYSDTVSAIYVPEGFDSNELTEHAFNAYGVSFGIGLGEMNGKAFRIGHLGSLTDVMVLSGLATIEMAMADLNYPFELGSGVRAAQEYYRATAAANQ

SEQ ID NO: 378 - protein, 396 aa, Stappia aggregata IAM 12614
MSFQNPVFIPGPTNMPEALRRACDMPTLDHRSPLFGQILQPALAGVKKVLKTETAEVFLFPSTGTGGWETAITNCLSPGDKILAARNGMFSHRWIDMCQRHGLKVEVVEAPWGTGLPADRYEEILTADTSHEIKAVLATHNETATGVKSDIAAVRRALNAAKHPALFFVDGVSSIASMDFRMDEWGVDAAVTGSQKGFMLPPGLAIIALSPKAQAAVESARLPRTFFDVRDMMKAYASNAYPYTPAVGLMNGLKQSCDMLLAEGLENVFARHHRIAEGVRAAVRAWGLELCARSPDIYSDSVSAIRTPEGFNATGIVTHAAAKYGVAFGVGLGEVAGKVFRIGHLGSLTDVMMLSGLATAEMVMADLGLDIKLGSGVAAAQEVYRSDSAIASKEAA

SEQ ID NO: 379 - protein, 406 aa, Sagittula stellata E-37
MLSPTGGDRMSNQNPVFIPGPTNMPDRLRLKMLAQTMDHRAPDFAGVFRPMLEDTKKVFGTAEGEVIAFPGSGTGGWEAAVANTLSPGDKVLVARYGLFSHKWIDLCQRFGLDMQVIDVPWGEGAPAARFEEILSADTGHEIKVVLVTHNETATGVLSDVGAVRRAMDAARHPAMMFVDCVSSLASVPFHFDAWGVDVAVSGSQKGFMLPAGMAITCVSKKAMAATEHARLPRCYFDFRDMLASNAKGGFPYTPPLQLIYGMREALDMLFEEGLEAVYARHVRLAEGVRRAVSAWGMELVAASPDLYSPTVSAVRVPEGFDSNALTEHAYIAYGVSFGVGLGQLDGKAFRIGHLGMLTDVMVLSGLATVEMAMADLGYPVRLGSGVAAAQEHYRSSRGAGALRDAA

SEQ ID NO: 380 - protein, 401 aa, Roseobacter sp. CCS2
MEDWMMSFQNPVFIPGPTNMPEAIRKACDMPTIDHRSPLFGQILHPARAGVQEILKSETAEIFIFPSTGTGGWETALTNTLSAGDTILAARNGMFSHRWIDMCLRHELNVKIVETPWGHGLPADRYAEILKADTEHKIKAVLATHNETATGVKSDIAAVRKALDAANHPAMLFVDGVSSIGSMDFRFDEWGVDVAVTGSQKGFMLPAGLAIVGFSQKALDASKTAGLPRTFFDIADMSKGYAANAYPYTPAVGLMNGLLLATETLLKEGLDNVFARHTRIASGVRAAVDGWGLELCAATPDIYSDTVSAIKTPEGFNATDIVTHAADKYGVAFGVGLGEVAGKVFRIGHLGSMTDVMALSGIATAEMCMVDLGLDIKLGSGVAAAQEYYRTSTGLSLEDAA

SEQ ID NO: 381 - protein, 397 aa, Roseobacter sp. AzwK-3b
MSFQNPVFIPGPTNMPEELRKAVDMPTLDHRSPLFADILHPALEGVKAVLKSQTAEVFVFPGTGTGGWETAISNTLSAGDAVLAARNGMFSHRWIDLCQRHGLDVQVIEAGWGAGLPADRYEEVLAADTGHRIKAVLATHNETATGVVSDIAAIRRAMDAASHPALLLVDGVSSIGSMDFRMDEWGVDIAVTGSQKGFMLPAGLAIVAFSPRAMQAVEGATLHRTYFDIRDMARGYAAGAYPYTPAVGLLNGLKMATGMLLDEGLDNVFARHHRIAGGVRRAVHAWGLELCADSPDLWSDTVSAIRMPEGVDANRFVAHAVERYGVAFGTGLGELAGKAFRIGHLGRMTDVMALSGIATAEMVMADLGMDIALGSGVAAAQAHYRLDPATTTRKEAA

SEQ ID NO: 382 - protein, 396 aa, Rhodobacteraceae bacterium KLH11 scf_1108856220445 genomic scaffold
MSNQNPVFIPGPTNIPDRLRLAMQVQTQDHRAPDFVETFAPVLEDTKKVFKTTDGQIVTFPASGTGGWEAAITNTLSPGDKVLVARYGVFSHRWIDLCERHGLDVQIVECPWGTGAPADKFEEILAADKAHQIKAVLVTHNETATGVRSDIGAVRRAMDAASHPAMMFVDCVSSLASMPFEFDQWGVDIAVSGSQKGFMLATGMAILCVSPKALAAMESAKLPRTFFDFRDMMAANASGGFPYTPPLQLIYGMGESLKMLFEEGLDNVYARHTRLAEGVRRATRAWGMELVAQSPDLYSDTVSAVYVPEGFDSNELTDHAFNAYGVSFGIGLGQMDGKAFRIGHLGSLTDVMVLSGLATIEMAMADLSYPVELGSGVAAAQEFYRTGSSKHTKAAA

SEQ ID NO: 383 - protein, 396 aa, Silicibacter sp. TrichCH4B genomic scaffold scf_1113354613205
MSFQNPVFIPGPTNIPESLRKACDMPTIDHRSPLFGQILHPARDGVRKVLKSETAEVFIFPSSGTGGWETALSNTLSAGDNVLAARNGMFSHRWIDMCQRHGLEVQIVETPWGAGLPADRYEEILSADKAHKIKAVLATHNETATGVKSDIAAVRRALDAAGHPALLFVDGVSSIASMDFRMDEWGVDVAVTGSQKGFMLSAGLAIVGFSPKAMEATKSAQLPRTFFDVHDMAKGYANNAYPYTPAVGMMNGLNESCKMLLAEGLENVFARHHRIAEGVRAAVGAWGLELCAATPEVYSDTVSAIRTPEGFNATDIVTHAADKYGVAFGVGLGEVAGKVFRIGHLGSLTDVMALSGIATAEMCMVDLGLDIQLGSGVAAAQEYYRGNAVSAQQDAA

SEQ ID NO: 384 - protein, 395 aa, Pelagibaca bermudensis HTCC2601 1100011001308
MSFQNPVFIPGPTNIPERLRKACDMPTIDHRSPLFGQILHPAREGVRKVLKSDSAEVFIFPSTGTGGWETALSNCLSAGDTVLAARNGMFSHRWIDMCQRHGLNVEIVETPWGHGLPADRYEEILTADTGHRIKAVLATHNETATGVKSDIAAVRRALDAAGHPALLFVDGVSSIASMDFRFDEWGVDVAVAGSQKGFMLPPGLAITGFSAKAMEATKTATLPRTFFDVADMAKGYANNAYPYTPAVGLLNGLNEACGMLLAEGLESVFARHHRIAEGVRAAVGAWGLELCAVSPDVYSDTVSAIRTPEGFNATRIVEHAASAYGVAFGTGLGEVAGKVFRIGHLGSLTDVMALSGIATAEMVMADLGLDIRLGSGVAAAQDYYRANRAPLRAAA

SEQ ID NO: 385 - protein, 396 aa, Paracoccus sp. J39 ICCT; identical to SEQ ID NO: 345

SEQ ID NO: 386 - protein, 396 aa, Paracoccus sp. J55
MTSQNPIFIPGPTNIPEEMRKAVDMPTIDHRSPVFGRMLHPALEGVKKVLKTETAQVFLFPSTGTGGWETAITNTLSPGDKVLAARNGMFSHRWIDMCQRHGLDVTYVETPWGEGIPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVESARLPRTFFDIRDMATGYARNGYPYTPPVGLINGLNLSCERLLAEGLENVFARHRRIAGGVRAAVEAWGLKLCAVRPELYSDSVSAIRVPEGFDANLIVSHALETYDMAFGTGLGQVAGKVFRIGHLGSLTDAMALSGIATAEMVMADLGLPIRLGSGVAAAQEHYRQTTAAAQKKAA

SEQ ID NO: 387 - protein, 396 aa, Rhodovibrio salinarum DSM 9154
MSQQNPVFIPGPTNVPDRLRRVMDMQTLDHRAPDFADTFQPVLAGVKRILKASSAQVMLFPASGTGGWEAAITNTLSPGDKVLAARYGMFSHRWIDLCQHHGLDVQVIDVEWGEGAPVEQYAEALQADSNHEIKAVLACHNETATGVVSDIAGLRNALDDTGHPALLFIDGVSSIASMDFRFDEWGVDIAITGSQKGFMLYTGMAIVAVSEKALQAMESARLPRCFLDFRDMLNANAQGSFPYTPPLQLIFGLSESIKMLEEEGLENVFARHHRLAEGVRQAAQAWGLPLCAKRPELYSDSVTAIHVPDGFDATALINHAYAAYGVSYGVGLGEVAGKVFRIGHLGSLTDVMALTGISTIEMAMHELGYPIQLGAGTAAAQAYYSKTRGELRAMAA

SEQ ID NO: 388 - protein, 396 aa, Rubellimicrobium mesophilum DSM 19309 (scaffold version)
VSAQNPVFIPGPTNMPEALRKACDMPTIDHRSAVFGEILAPCLAGVRRVLKSERAQVFLFPSTGTGGWETAISNTLSPGDKVLAARHGMFSHRWIDLCQRHGLSVQVVEAPWGAGLPADRYAEILAADTAHEIKAVLATHNETATGVRSDIAAVRRTLDAAGHPALLLVDGVSSIASMDFRMDQWGVDVAVTGSQKGFMLPAGLAIVAFSDKAWRATETAKLPRTFFDVRDMGQSYARNGFPYTPPVGLMNGLRLSTEMLLKEGLENVFARHRRIADGVRAAVAAWEMPLCAEGPELWSDTVSAIRTPEGFDATKIVTHAAAKYGVAFGVGLGEVAGKVFRIGHLGSLTDVMMLSGLATAEMAMADLGLPVRLGSGVAAAQEVYRASEAKLEKAAA

SEQ ID NO: 389 - protein, 398 aa, Maritimibacter sp. HL-12
MSLQNPVFIPGPTNIPEALRKACDMPTIDHRSSVFPQILQPALAGVKRVLKTEAGEAIVFPGTGTGGWEAAISNTLSPGDKVLAANFGMFSAKWIDMCRRHGLEVQVVEAPWGAALPVATFAEILAADTGHEIRAVLATHNETATGVRSDIAGLRAAMNAADHPALLFVDGVSSIASMDFRMDEWGIDVAITGSQKGFMLPAGLAIVAVSRKAVAAMERATLPRFYFDFRDMLAMNPASGYPYTPVVGLLNGLKASIEMLEAEGLDAVFARHAHIADGVRVAVGAWGLRFCAIAPDARSDTVTAIVLPDGIDGNAFVAHAETRYGTSFGAGLGAVAGKVFRIGHLGQLSETQALAGIATAEMVLADLGVDIALGSGVAAAQGVYRSAVKGHGSARAAA

SEQ ID NO: 390 - protein, 396 aa, Methylobacterium sp. L2-4
MFAQNPVFIPGPTNMPEVLRRAADMPTLDHRSPLFAQILHPALAGVKTVLKSQDAEVFVFPSTATGGWETALSNTLSAGDAVLAARHGMFSHRWIDMTRRHGLDVRVIEAPWGEGLPADRFAEALAADTAHRIRAVLVTHNETATGVRSDVAAVRRALDASGHPALLLVDGVSSIASMDFRMDEWGVDVAVTGSQKGFMLPAGLAIVAFSPRAMAATATATLPRTYFDVRDMAKGYPNGAYPYTPAVGLLNGLKLSTELLLAEGLDNVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMADLGLRIELGSGVAAAQAVYRRAPAAGLRAAA

SEQ ID NO: 391 - protein, 399 aa, Ensifer fredii GR64
MHMQNPVFIPGPTNMPEVLRKASDMPTIDHRSSLFGEILRPALAGVQKVVKSEAASIFVFPATGTGGWETAITNTLSPGDRVLAARNGMFSHRWIDMCQRHGLNVEIILASWGSGAPAERYEEILVADKAHEIKAVLVTHNETATGVRSDIAAVRRAIDAARHPAMLFVDGVSSIASLDFRMDEWGVDVAVTGSQKGFMLPAGLAITAFSPKALAALETAKLPRTFFDVRDMAKSYAGNAYPYTPAVGLLNGLKVSTEILLEERLENVFARHKRIASGVRAAVGAWGLELCATSEDLYSDTVSAIRTPEGFDATSVVTHAAKKYDVAFGVGLGEVAGKVFRIGHLGSLTDVMALSGIATAEMVMADLGLPIKLGSGVAAAQQYYRENDVSAVRKSAEEI

SEQ ID NO: 392 - protein, 396 aa, Ensifer fredii GR64
MSGYNHLFIPGPTNIPEQVRQAMNLPMEDMRSPRYPELTLPLFADVKKVFKNRNGRVFIYPSSGTGAWEAAMTNVLSPGDKVLMSRFGQFSHLWVDMAERLGFEVDCLDREWGTGVPVKLYAERLAADKAHKIKAVFVTHNETATGVTSDVAAVRAALDACGHPALLFVDGVSSIGSIDFRQDEWGVDCAVSGSQKGFMLPAGLGFLSVSQKALDAAKTARHMRCYFSFEDMIKTNDTGYFPYTPPTQLLRGLRAALDLIFEEGLENIFARHHHLADGVRAAVSAWGLKLCATEPKWHSDTVSAIRLPEGVDGVEVIRHAYRTYNTSLGSGLSKVAGKVFRIGHLGSLNEVMVLGALSAAELTLLDCGVKIEPGVGVGAAIRQFRSAAATATAEAA

SEQ ID NO: 393 - protein, 395 aa, Ponticoccus litoralis DSM 18986
MSFQNPVFIPGPTNIPERLRKACDMPTIDHRSPLFGQILHPAREGVRKVLKSESAEVFIFPSTGTGGWETALSNCLSAGDTVLAARNGMFSHRWIDMCQRHGLDVEIVETPWGQGLPADRYEEILTADTGHRIKAVLATHNETATGVKSDIAAVRRALDAAGHPALLFVDGVSSIASMDFRFDEWGVDVAVTGSQKGFMLPPGLAITGFSPKAMAATRTATLPRTFFDVADMAKGYANNAYPYTPAVGLLNGLNEACGMLLSEGLDNVFARHHRIAEGVRAAVKAWGLELCAASPEVYSDTVSAIRTPEGFDATRIVEHAASAYGVAFGTGLGEVAGKVFRIGHLGSLTDVMALSGIATAEMVMADLGLNITLGSGVAAAQDYYRANRTALQAAA

SEQ ID NO: 394 - protein, 396 aa, Rhizobium sp. OK494
MYMQNPVFIPGPTNMPEILRKAADMPTLDHRSPLFGQILRPALAGVKKILKTEAASVYVFPSTGTGGWETAITNTLSPGDRVLAARYGMFSQRWIDMCQRHGLKVDIIEAAWGGGAPAARYEEILAADTAHEIKAVLVTHNETATGVKSDIAAVRRAIDAARHPALLFVDGVSSIASMDFRMDEWLVDIAVTGSQKGFMLPAGLAITAFSPKALAAVETAKLPRTFFDIGDMARSYANNAYPYTPAVGLLNGLKLSTELLLAEGLENVFARHRRIASGIRAAVRAWGLELCAMSEDLYSDTVSAIRTPEGFDATSIVAHAAKTYDVAFGVGLGEVAGKVFRVGHLGSLTDVMALSGIATAEMVMVDLGLDIKLGSGVAAAQDYYRDGRTSKVRAAA

SEQ ID NO: 395 - protein, 388 aa, Planktotalea frisia DSM 23709
VSFQNPVFIPGPTNMPEEIRLATYMPTIDHRSPVFGGILHPCLDGVRRVLKSETAHIFIFPSTGTGGWETTLTNTLSAGDKVLVARNGMFSHRWIDMCERHGLDVQVVDVAWGEGLPVAEYAAILKADKDHTIKAVLATHNETATGVKSDIAGVRGALDAANHPALFFVDGVSSIGSMDFRMDEWGVDVAVTGSQKGFMLPAGLAIVGFSEKARAAVESATLPRTFFDIRDMEKGYAANAFPYTPPVGLMNGLKCAIEMIEAEGLENVFARHTRIATGVRHAVEAWGLELCANAPELYSDSVSAIRTPEGFNATDIVTRADEQYGMAFGVGLGDVAGKVFRIGHLGMLTDAMMLSGLGVAEMVMKDLGLDIKLGSGVGAAQEFYRYGS

SEQ ID NO: 396 - protein, 396 aa, Paracoccus denitrificans DSM 415; identical to SEQ ID NO: 304

SEQ ID NO: 397 - protein, 396 aa, Paracoccus halophilus CGMCC 1.6117
MTSQNPIFIPGPTNIPEEMRKAVDMPTIDHRSPVFGRMLHPALEGVKKVLKSTQAQVFVFPSTGTGGWETAITNTLSPGDKVLAARNGMFSHRWIDMCQRHALDVTFVETPWGEGVPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVETARLPRTFFDIRDMATGYARNGYPYTPPVGLINGLNLSCERLLSEGLENVFARHNRIASGVRAAVGAWGLKLCAVRPELYSDSVSAIRVPEGFDANRIVSHALETYDMAFGTGLGEVAGKVFRIGHLGSLTDAMALSGISVAEMVMADLGLPIKLGSGVAAAQEHYRQTAAAAQKKAA

SEQ ID NO: 398 - protein, 397 aa, Roseovarius tolerans DSM 11457
MSDQNPVFIPGPTNIPDRLRRAMQVQTQDHRSPAFVNTLTPVLAGCLTVFGASEAEIITFPASGTGGWEAAITNTLSPGDTVLVARYGMFSHRWIDMCARHGLNVQIIECPWGSGAPADKFEAALRADTAHKIKAVLVTHNETATGVRSDIGAVRGAMDAAAHPALLMVDCVSSLASMPFEMDAWGVDIAVAGSQKGFMLNTGMAILAVSDKALAAMDSATLPRTFFDFRDMLTTNAKGGYPYTPPLQLIYGMAESLNMLFEEGLENVYARHTRLAEGVRRAVEAWGLRLVAQSPELYSDTVSAIYVPDGFDSNALTEHAFATYGMSFGVGLGEMNGRAFRIGHLGSLTDAMMLSGLATIEMAMADLNYPVKLGSGVIAAQDYYRKTAKPVLTEQAA

SEQ ID NO: 399 - protein, 396 aa, Jannaschia pohangensis DSM 19073
MTSQNPVFIPGPTNMPEAVRLACHMPTMDHRSPAFADILHPCLDGVRRVLKSTEVEVFIFPSTGTGGWETAISNTLSPGDRVLVARNGMFSHRWIDMCQRHGLDVQIVETPWGHGIPVSTYEEILRADTGHAIKAVLATHNETATGVKSDIAGVRRAMEAAGHPALLMVDGVSSIGSMDFRFDEWGVDIAVTGSQKGFMLPAGLAILGFSPRAMAATKTAKLHRTFFDVADMAKGYANNAFPYTPPVGLMNGLKLACDMLLSEGLENVFARHHRMAEGVRRAVDAWDLKLCAASPDVWSDSVSAICTPAGFNATDVVTVAARDYDMAFGVGLGEVAGKVFRIGHLGMLTDAMMLSGLAVAEMAMVDLGLPIKLGSGVAAAQDYYRHGNTQQKAAAE

SEQ ID NO: 400 - protein, 396 aa, Ruegeria sp. 6PALISEP08
MSQQNPVFIPGPTNIPDRLRLAMQVQTQDHRAPDFVETFAPVLEDTKKVFGTDQGQVITFPASGTGGWEAAVTNTLSPGDAVLVARYGMFSHRWIDLCQRHGLDVRIIECPWGSGAPAQKFAEALAADNSHEIKAVLVTHNETATGVRSDIAAVRKAMDASTHPALLFVDCVSSLASMPFEFDDWGVDIAVSGSQKGFMLATGMAILCVSPKALAAMETANLPRTFFDFRDMMNANASGGFPYTPPLQLIYGMRESLKMLFEEGLDNVYARHFRLAEGVRKATSAWGLELVAQSPDLYSDTVSAIFVPDGFDSNALTDHAFNAYGVSFGIGLGEMNGKAFRIGHLGSLTDVMVLSGLATIEMAMADLDYPIELGSGVAAAQAYFRVGHATPMQSAA

SEQ ID NO: 401 - protein, 396 aa, Mesorhizobium sp. F7
MYSQNPVFIPGPTNMPEILRKAADMPTLDHRSPLFGQILRPVLAGVKKILKTEDAEIFLFPSTGTGGWETALTNTLSAGDGVLAARYGMFSHRWIDMCRRHGLDVTVVETSWGSGLPADRYEEILTADKEHRIKAVLATHNETATGVRSDIAAVRRALDAAKHPAMLMVDGVSSIASMDFRMDEWGVDIAVTGSQKGFMLPAGLAIVAFSSKAMDATAAAGLPRTFFDVRDMARNYANGGYPYTPAVGLLNGLKVSTELLLGEGLDNVFARHRRIASGIRAAVKAWGLELCAQSEDLYSDTVSAIRTPEGFNASDIVSHAARKYDIAFGVGLGDVAGKVFRIGHLGSLTDVMALSGVAAAEMAMVDLGLGIKLGSGVAAAQEYYRGADAAQIRVAA

SEQ ID NO: 402 - protein, 393 aa, Neptunomonas antarctica S3-22; identical to SEQ ID NO: 323

SEQ ID NO: 403 - protein, 397 aa, Oceanicola nitratireducens CGMCC 1.7292
MSFQNPVFIPGPTNIPESLRKACDMPTIDHRSPLFGQILHPAREGVRKVLQSESAEIFIFPSTGTGGWETALSNTLSSGDTVLAARNGMFSHRWIDMCQRQRLRVEIVETPWGEGLPADRYAEILAADKHHRIKAVLATHNETATGVRSDIAAVRHALDAAGHPALLFVDGVSSIGSMDFRFDEWGVDCAVTGSQKGFMLPPGLAIVGFSEKAMEATKIAMLPRTFFDVHDMAKGYANNAYPYTPAVGLMNGLNEACRMLLDEGLENVFARHHRIAEGVRCAVRAWGLNLCAASPDIYSDTVSAIRTPKGFNATDIVSHAAQTYGVAFGTGLGEVAGKVFRIGHLGSLTDVMMLSGLATAEMCMADLGLDITLGSGVAAAQEFYRATPALSRKVAAE

SEQ ID NO: 404 - protein, 396 aa, Sinorhizobium fredii CCBAU 25509
MHMQNPVFIPGPTNMPEVLRKASDMPTIDHRSSLFGEILRPALAGVQKVVKSEAASIFVFPATGTGGWETAITNTLSPGDRVLAARNGMFSHRWIDMCQRHGLNVEIILASWGSGAPAERYEEILVADKAHEIKAVLVTHNETATGVRSDVAAVRRAIDAARHPALLFVDGVSSIASMDFRMDEWGVDVAVTGSQKGFMLPAGLAITAFSPKALAALETAKLPRTFFDVRDMAKSYAGNAYPYTPAVGLLNGLKVSTEILLAEGLENVFARHTRIASGVRAAVGAWGLELCATSEDLYSDTVSAIRTPEGFDATSVVTHAAKKYDVAFGVGLGEVAGKVFRIGHLGSLTDVMALSGIATAEMVMADLGLGVRLGSGVAAAQEYYRNNQVSAVQGTA

SEQ ID NO: 405 - protein, 396 aa, Leisingera sp. ANG-M6
MSFQNPVFIPGPTNMPEALRKAVDMPTLDHRSPLFGQILHPALAGVKKVLKSESAEIFVFPSTGTGGWETAITNTLNSGDKILAARNGMFSHRWIDMCQRHGLDVQVVETPWGEGLPADRYEEILTADTSHQIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVRAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNTASSTKAAA

SEQ ID NO: 406 - protein, 396 aa, Leisingera sp. ANG-M7
MSFQNPVFIPGPTNMPEALRKAVDMPTLDHRSPLFGQILHPALAGVKKVLKSESAEIFVFPSTGTGGWETAITNTLNAGDKILAARNGMFSHRWIDMCQRHGLDVQIVETPWGEGLPADRYEEILTADTAHEIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVHAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNTASSTKAAA

SEQ ID NO: 407 - protein, 396 aa, Loktanella maricola DSM 29128
MSFQNPVFIPGPTNMPEAIRKACDMPTIDHRSPLFGQILHPARAGVQKILKSETAEVFIFPSTGTGGWETALTNTLSAGDTVLAARNGMFSHKWIDMCLRHELNVKIVETPWGHGLPAGRYAEILMADTEHKIKAVLATHNETATGVKSDIAAVRKALDAANHPAMLFVDGVSSIGSMDFRFEEWGVDVAVTGSQKGFMLPAGLAIVGFSQRAMDASKTAGLPRTFFDIADMTKGYEANAYPYTPAVGLMNGLLLATETLLKEGLDNVFARHNRIASGVRAAVDAWGLGLCAATPDVYSDTVSAIKTPEGFNATDIVAHAADKYGVAFGVGLGEVAGQVFRIGHLGSMTDVMALSGIATAEMCMVDLGLDIKLGSGVAAAQEYYRGTTGLSLKDAA

SEQ ID NO: 408 - protein, 396 aa, Loktanella sediminum DSM 28715
MSFQNPVFIPGPTNIPENLRKACDMPTIDHRSPLFGSILHPALDGVRQILKTTKAEVFIFPASGTGGWETAITNTLSAGDTILVARNGMFSHRWIDLCERHGLNVQIVETNWGDGISAEKYAEILSKDKALKIKAVLATHNETATGVKSDIASIGRAVKSVNHPALFMVDGVSSIGSMDFQFDNWGVDVAVTGSQKGFMLPAGLAILGFSERAMAATKSGTLHRTFFDVHDMQAGYANNAYPYTPAVGLMNGLNEACKMLLDEGLDNVFARHTRIASGVRAAVSAWGLELCATAPEFYSDTVSAIRTPAGFNATDIVTHAAETYGVAFGVGLGEVAGKVFRIGHLGSLTDVMALSGIATAEMCMVDLGLDIELGSGVAAAQEVYRAGPAIENRKVA

SEQ ID NO: 409 - protein, 397 aa, Tateyamaria sp. ANG-S1
MSFQNPVFIPGPTNIPESLRKSCDMPTIDHRSPLFGGILNAARDGVRQVLKSETADVFIFPATGTGGWETALTNTLSHGDTVLAARNGMFSHRWIDMCQRLRLDVRVVETPWGHGIPHAQFAEILAADTSHQIKAVLATHNETATGVTSDIAAVRNAMDASDHPALLFVDGVSSIGSIDFQFDGWGVDVAVTGSQKGFMLPAGLAIVGFSAKAMAAQPSAQLPRTFFDIRDMADGYAAGAYPYTPAVGLMNGLSHACTMLLSEGLDTVFARHHRIASGVRAAVSAWGLELCAASPDLYSDTVSAIRTPAGFDASRIVSHAATTYGVAFGGGLGEVAGKVFRIGHLGSLTDVMALSGIATAEMCMADLSLDITLGSGVAAAQQVYRAHGAANVQKDAA

SEQ ID NO: 410 - protein, 396 aa, Labrenzia alexandrii CECT 5112
MSFQNPVFIPGPTNMPDALRKACDMPTLDHRSPLFGEILQPALSGVKKILKSELAEVFIFPSTGTGGWETVITNTLSPGDKILAARNGMFSHRWIDLCQRHGLDVVIVDAPWGTGLPADRYEEILAADTHHEIKAVLATHNETATGVKSDIAAVRRALNNAKHPALLYVDGVSSIASMDFRMDEWGVDAAVTGSQKGFMLPAGLAIVGLSPKAQTAVDQAKLPRTFFDIRDMRKSYAVNAYPYTPAVGLLNGLKHSCDMLLSEGLDNVFARHHRIAEGVRAAVHAWGLQLCAGSRDVYSDTVSAIRTPEGFNATGIVTHAAGKYGVAFGVGLGEVAGKVFRIGHLGSLTDVMTLSGLATAEMVMADLGLSIKLGSGVAAAQDYYRTEEAVSSKEAA

SEQ ID NO: 411 - protein, 397 aa, Roseovarius litoreus DSM 28249
MSFQNPVFIPGPTNMPEELRKAVDMPTLDHRSPLFAAILHPALDGVKAVLKSQTAEVFVFPGTGTGGWETAISNTLSAGDAVLAARNGMFSHRWIDLCQRHGLDVQVIEAGWGAGLPADRYEEILAADTGHRIKAVLATHNETATGVVSDIAAIRRAMDAAGHPALLLVDGVSSIGSMDFRMDDWGVDIAVTGSQKGFMLPAGLAIVAFSPRAMQAVEGATLHRTYFDIRDMARGYAAGGYPYTPAVGLLNGLKMATGMLLDEGLDNVFARHHRIAEGVRRAVHAWGLELCADSPDLWSDTVSAIRMPEGVDANRFVAHAVERYGVAFGTGLGELAGKVFRIGHLGRMTDVMALSGIATAEMVMADLGMDIALGSGVAAAQAHYRLDPATTTRKEAA

SEQ ID NO: 412 - protein, 396 aa, Labrenzia sp. CP4
MSFQNPVFIPGPTNMPEALRRACDMPTLDHRSPLFGQILQPALAGVKKVLKTETAEVFLFPSTGTGGWETAITNCLSPGDNILAARNGMFSHRWIDMCQRHGLKVDVVEAAWGTGLPADRYEEILAADTNHEIKAVLATHNETATGVKSDIAAVRRALNAAKHPALLFVDGVSSIASMDFRMDEWGVDAAVTGSQKGFMLPPGLAIIALSPKAQAAVESARLPRTFFDVRDMMKAYANNAYPYTPAVGLMNGLKQSCDMLLAEGLDNVFARHHRIAEGVRAAVRAWGLELCAQTPDVYSDSVSAIRTPGGFNATGIVTHAAAKYGVAFGVGLGEVAGKVFRIGHLGSLTDVMMLSGLATAEMVMADLGLDIQLGSGVAAAQEVYRSDSAIASKEAA

SEQ ID NO: 413 - protein, 396 aa, Rhizobium sp. N541; identical to SEQ ID NO: 369

SEQ ID NO: 414 - protein, 396 aa, Paracoccus sp. MKU1
MTSQNPIFIPGPTNIPEEMRKAVDMPTIDHRSPVFGRMLHPALEGVKKVLKTTQAQIFLFPSTGTGGWETAITNTLSPGDKVLAARNGMFSHRWIDMCQRHGLDVTFVETPWGEGIPADRFEEILTADKGHEIRAVLATHNETATGVKSDIAAVRRALDNAKHPAMLFVDGVSSIGSMDFRMDEWGVDIAVTGSQKGFMLPPGLAIVGFSPKAMEAVESARLPRTFFDIRDMATGYARNGYPYTPPVGLINGLNASCERILAEGLENVFARHHRIASGVRAAVEAWGLKLCAARPELYSDSVSAIRVPEGFDANLIVSHALETYDMAFGTGLGQVAGKVFRIGHLGSLTDAMALSGIATAEMVMADLGLPIRLGSGVAAAQEHYRQTTAAAQKKAA

SEQ ID NO: 415 - protein, 396 aa, Pseudoruegeria marinistellae SF-16
MSFQNPVFIPGPTNIPESLRKACDMPTIDHRSPLFGQILHPAREGVRKVLKSDSAEVFIFPSTGTGGWETALTNTLSPGDKVLAARNGMFSHRWIDMCQRHGLDVQIVEAQWGAGLPADRYEEILTADKGHEIKAVLATHNETATGVKSDIAAVRRALDAAGHPALLFVDGVSSIASMDFRFDAWGVDVAVTGSQKGFMLTAGLAITGFSEKAMAATGSATLPRTFFDIRDMETGYANNAYPYTPAVGLLNGLNEACRMLLDEGLENVFARHHRIAEGVRAAVRAWGLELCAISPEVYSDTVSAIRTPDGFNATDIVTHAANTYGVAFGVGLGEVAGKVFRIGHLGSLTDVMTLSGIATAEMCMADLGLDITLGSGVAAAQEYYRAHSALPQKDAA

SEQ ID NO: 416 - protein, 396 aa, Ruegeria conchae DSM 29317
MSNQNPVFIPGPTNIPDRLRLAMQVQTQDHRAPDFVETFAPVLEDTKKVFGTTEGQIITFPASGTGGWEAAITNTLSPGDKVLVARYGVFSHRWIDLCERHGLDVQIVECTWGTGAPADRFEAILSADKAHDIKAVLVTHNETATGVRSDIRAVRHAMNAANHPAMMFVDCVSSLASMPFEFDQWGVDIAVSGSQKGFMLATGMAILCVSPKALAAMETAKLPRTFFDFRDMMAANASGGFPYTPPLQLIYGMRESLKMLFEEGLDNVYARHTRLAEGVRRAANAWGLKLVAQTPDLCSDTVSAIYVPEGFDSNELTDHAFNTYGVSFGIGLGELNGKAFRIGHLGSLTDVMVLSGLATIEMAMADLNYPIELGGGVAAAQEFYRAGTSGHAKAAA

SEQ ID NO: 417 - protein, 396 aa, Labrenzia sp. C1B10
MSFQNPVFIPGPTNMPEALRRACDMPTLDHRSPLFGQILQPALAGVKKVLKTETAEVFLFPSTGTGGWETAITNCLSPGDKILAARNGMFSHRWIDMCQRHGLKVEVVEAAWGTGLPADRYEEILAADTNHVIKAVLATHNETATGVKSDIAAVRRALNAAKHPALLFVDGVSSIASMDFRMDEWGVDAAVTGSQKGFMLPPGLAIIALSPKAQAAVESARLPRTFFDVRDMMKAYANNAYPYTPAVGLMNGLKQSCDMLLAEGLDNVFARHHRIAEGVRAAVRAWGLELCAQTLDVYSDSVSAIRTPEGFNATGIVTHAAAKYGVAFGVGLGEVAGKVFRIGHLGSLTDVMMLSGLATAEMVMADLGLDIKLGSGVAAAQEVYRSDSAIASKEAA

SEQ ID NO: 418 - protein, 396 aa, Methylobacterium radiotolerans NDB3P7; identical to SEQ ID NO: 337

SEQ ID NO: 419 - protein, 391 aa, Psychrobacter arcticus 273-4
MSLQNPIFIPGPTNIPDRLRRAMNVPTQDHRAPDFSDTFLPVLADCKKVFGTQDSEIILFTSSGTGGWEAAISNTLSPGDKVLIARYGMFSHRWIDMCQRHGLDVQVIECPWGTGAPADQFQAILSEDTAHEIKAVMVTHNETATGVLSDIGAVRKAIDSSNHPALLFVDGVSSIASVPFEMDEWGVDVAVAGSQKGFMLATGMAILGVSQKALSHMDEAKLPRTYFDFRDMLKANANGGFPYTPPLNLIYGLRESLEMLFDEGLENVYARHYRLAEGVRQAVSAWGMILCAKTPDLYSNTVSAIFVPEGFNSNKLTDHAFNKYGISFGIGLGEMNGKAFRIGHLGSLTEVMVLAGLAAIEMAMVDLDYPIKLGQGVAAAQEYYRNTATTK

SEQ ID NO: 420 - protein, 469 aa, Roseovarius sp. 217
MAVIPLVAVVVGDCMQNKKYFHVILLIRYEKIKIKQYHMFDYFINIMKIPFKKIAKADFLRHSMLISEEDGAMSDQNPVFIPGPTNIPDRLRRAMQVQTQDHRSPAFVNTLNPVLKGCKTVFSTTKGEIITFPASGTGGWEAAITNTLSPGDKVLVARYGMFSHRWIDMCQRHGLDVQIIECPWGSGAPADRFQEALTADKGHSIKAVLVTHNETATGVRSDIAAVRGAMNSAKHPALLMVDCVSSLGSMPFEMDDWGVDIAVSGSQKGFMLNTGMAILAVSPKALAMMETAKLPRTFFDFRDMMGANAKGGFPYTPPLQLIYGMAESLNMLFEEGLENVYARHARIAEGVRRAVDAWGLKLVAQTPDLYSDTVSAVFVPEGFDSNRLTERVFGTYGMSFGVGLGEMNGRAFRIGHLGSLTESMMLSGLATLEMAMVDLNYPVKLGSGVIAAQEYYRSTAKPVLAEKAA

SEQ ID NO: 421 - protein, 389 aa, Marinobacter sp. ELB17
MSDQNPIFIPGPTNIPDRLRFAMNVQSSDHRSPGFVETLSPLLQDCKKVFNTQSGEVILFPASGTGGWEAAICNTLSPGDKVLIARYGMFSRRWIEMCQRHGLDVQIIECPWGSGAPANEFKRALSADTQHKIKAVLVVHNETATGVTSDIDAVRQAMDSCFHPALLLVDCVSSLASMPFEMDNWGVDIAVSGSQKGFMLITGMAILAVSQKALVAMETAKLSCAFFDFRAMMTANAQGGFPYTPPLQLIYGLKESLKMLFEEGLDNVYARHFRLAEGVRQAAHAWGMALCAQSPDLYSNTVTAIYVPEGLNSNELTDHTFAKYGVSFGIGLGEMHGKAFRIGHLGSLTDSMVLSGLATIEMAMADLDYPIELGTGVRAAQNHFRATIA

SEQ ID NO: 422 - protein, 396 aa, Rhizobium leguminosarum bv. trifolii WSM597
MYTQNPVFIPGPTNMPEVLRRATDLPTIDHRSAAFADILQPALAGVRKVVKSETAEVVVFPATGSGGWEATITNLLSPGDRVLAARCGVFSHRWIDMCQRHGLQVDTVHASWKQPLPLAEYEKRLLADKEHAIKAVLVTHNETGTGVRSDVGAVRRLLDEARHPALLLVDGVSSIASMDFRMDEWKVDAAITGSQKGFMLPVGLAILALSAKAMQATQSATLHRGFFDIREMAKTYPSSGYPYTPSIGLLNGLKVSTELLLGEGLDNVFKRHARIASGVRAAVSAWGLSLYAQEKSSFSDTVSAIETPEGFDATSIVTHAAQKYGVAFGAGLADVAGRVFRIGHLGSMSDVMALSGIATAEMAMVDLGLPIRLGSGVAAAQEIYRNTTASPVRNAA

SEQ ID NO: 423 - protein, 396 aa, pMeth_A285
MSFQNPVFIPGPTNMPEALRKAVDMPTLDHRSPLFGQILHPALAGVKKILKSETAEIFVFPSTGTGGWETAITNTLNAGDKILAARNGMFSHRWIDMCQRHGLDVQVVETPWGAGIPADRYEEILTADKGHEIKVVLATHNETATGVKSDIAAIRRALDAAGHPALLFVDGVSSIASMDFRMDEWGVDIAVTGSQKGFMLPPGLAIVGFSPKAMKAADTATLPRTFFDIKDMAAGYANSAYPYTPSIGLLNGLNMACGMLLDEGLENVFARHHRIAEGVRAAVRAWGLELCAVSPDIYSDSVSAIRTPDGFDANKFVSLAAEKYGVAFGTGLGEVAGKVFRIGHLGSLTDVMALSGIATAEMVMADLGLNIQLGSGVAAAQDYYRGNSANSAKAAA

SEQ ID NO: 424 - protein, 396 aa, Roseobacter litoralis Och 149
MSDQNPVFIPGPTNIPDRLRAAMHVQTRDHRAPDFVETFAPVLEDTKKVFGTTSGRVITFPASGTGGWEAALCNTLSPGDKVLVARYGMFSHRWIDMCERHGLDVQLIECPWGTGAPADKFEAALSADKSHSIKAVLVTHNETATGVKSDVAAVRGAMDAAAHPALLFVDCVSSLASMPFEMDSWGVDIAVSGSQKGFMLATGMAILGVSDKALAAMEAATLPRTFFDFKDMMGANASGGFPYTPPLQLIYGMRESLKMLLEEGLDNVYARHTRLAEGVRRAVGAWGLELVAQTPDLYSDTVSAIYVPSGFDSNALTDQAFNQYGVSFGVGLGEMNGKAFRIGHLGSLTDVMVLSGLATIEMAMADLDYPIELGSGVAAAQEHFRSKTGAAIKSAA

SEQ ID NO: 425 - protein, 388 aa, Octadecabacter antarcticus 307
MSFQNPVFIPGPTNMPEAIRQACYMPTIDHRSPMFGKILHPVLDGVRRVLKSKTAKIFIFPSTGTGGWETALSNCLNAGDKVLAARNGMFSHRWIDMCLRHGLDVQVVETPWGHGLPAAEYEDILKADKNHDIKVVLATHNETATGVKSDIAAVRKALEAANHPAMLFVDGVSSIGSMDFRMDEWGVDVAVTGSQKGFMLPAGLAIVGFSDRAMQATKTSTLPRTFFDVHDMQKGYDNNAFPYTPPVGLMNGLKLALEMIEEEGLENVFTRHRRIATGVRLAVKAWGLELCAVSPDVYSDTVSAIKTPDGFNATDIVTRAADKYGMAFGVGLGEVAGNVFRIGHLGMLTDAMMLSGLGVAEMVMVDLGLDVKLGSGVAAAQQFYRHGI

SEQ ID NO: 426 - protein, 396 aa, Methylopila sp. M107
MHMQNPVFIPGPTNIPEVLRKAVDMPTLDHRSSLFGDILAPALAGSKQVLKTETADCFILPATGTGGWETAICNTLSPGDAVLAARHGMFSHRWIDMCRRHQLSVEKVDGRWGTAAPADRFEEILAGDKAHRIKAVLVTHNETATGVRSNIREIRTAIDRARHPAFLFVDGVSSIGSMDFRMDEWGVDVAVTGSQKGFMLPAGLAIVAFSQRAMEATARAKLPRAFFDIRDMAKSYASGGYPYTPTVGLLNGLKVSTELLLAEGLDSVFARHRRIATGVRAAVAAWGFRLCAEEPSIYSETVSAIRTPEGFDATSIVTHASRKYDVAFGVGLGDVAGKVFRIGHIGSLTDVMALSGIAAAEMAMVDLGLKVDLGSGVSAAQDVYRMAHDTEALAAA

SEQ ID NO: 427 - protein, 396 aa, Loktanella sp. SE62
MSFQNPVFIPGPTNIPEAIRKACDMPTIDHRSPIFGQILQPAREGVRAVLISQDAEIIIIPASGTGGWETALTNTLSPGDTVLAARNGMFSQRWIEMCRRLGLAVEIVDTPWGNGIPADRYEEALRADKHHKIKAVLATHNETATGVASDIAAVRRAMDAANHPALLFVDGVSSIGSIDFRFDDWGVDVAVTGSQKGFMLPAGLAILGFSPKALDAGKHATMPRAYFDVADMQASYAKNSYPYTPSVGLLNGLLLSTQMLLAEGLENVFARHTRIATGVRAAVQAWGLKLCAASPDLYSDTVSAIMTPPGFNATDIVTHAAETYGVAFGVGLGEVAGKLFRIGHLGSMTDVMALSGIATAEMCMVDLGLDITLGSGVAAAQDYYRGSTGHVMKDAA

SEQ ID NO: 428 - protein, 396 aa, Phaeobacter gallaeciensis ANG1 (ANG1); identical to SEQ ID NO: 322

SEQ ID NO: 429 - protein, 396 aa, Rhodobaca barguzinensis DSM 19920
MSTHNPVFIPGPTNIPEEIRKACDIPTLDHRSPAFARLFKPAVAGIRRVLAMDQGEIIILPSTGTGGWEAAITNTLSSGDKVLAPRFGMFSHRWIDLCQRHGLDVQIIETPWGQGAPLAEIEAALRADSAHEIKAVLATHNETATGVRSDIAGIRRALDAAGHPALLLVDGVSSIGSMPFDMAGWGVDIAVAGSQKGFMLPAGLAILGVSPKALNAMEKATLPRTFFDFRDMLAAYAAGGYPYTPAVGLIAGLAKAIEMLEDEGLENVYARHHRLAEATRRAVAAWGMRPCAATPELYSDTVTAVVVPEGCNGTDLVQLAASKYGVAFGVGLGEVAGKVFRIGHLGMLSDVMLLSGLATAEMCMADLGWDVQLGSGVAAAQEYLRNSAGVALARAA

SEQ ID NO: 430 - protein, 396 aa, Mameliella alba DSM 26384
MTDQNPVFIPGPTNMPDRLRRAIQIQTRDHRAPDFVDTFAPVLEDTKKVFGSTEGKIITFPASGTGGWEAAVTNTLSPGDKILVGRYGVFSNKWIDLCQRHGLDVQIVETPWGEGVPADKFAEILSADTAHEIKAVLTTHNETATGVRSDIAAVRRALDGADHPAMLFVDCVSSLASMPFEFDAWGVDIAVSGSQKGFMLPTGMAILCVSPKALAAIETAGLSRTFFDFRDMMKANATGGFPYTPPLQLIYGLRESLDMLFEEGLENVFARHFRLAEGVRRAVDAWGMKLVAKSPDLYSDTVSAVYVPEGFDSNALTDHAYRAYKVSFGVGLGQLDGKAFRIGHLGSLTDVMVLSGLATIEMAMADLNYPITLGSGVAAAQEYYRTSRVAALKSAA

SEQ ID NO: 431 - protein, 396 aa, Paracoccus denitrificans DSM 15418; identical to SEQ ID NO: 304

SEQ ID NO: 432 - protein, 396 aa, Ruegeria halocynthiae MOLA R1/13b
MSNQNPVFIPGPTNIPDRLRLAMHVQTQDHRAPDFVDTFMPVLEGTKKVFGTTTGQIVTFPASGTGGWEAAITNTLSPGDKVLVARYGVFSHRWIDLCERHGLDVQVIECPWGSGAPADQFQTALADDTAHEIRAVLVTHNETATGVRSDISAVRRAMDVTDHPAMLFVDCVSSLASMPFAFDDWGVDIAVSGSQKGFMLATGMAILCVSPKAQEAMASAKLPRTFFDFGDMMAANASGGFPYTPPLQLIYGMRESLNMLFEEGLENVYARHFRLAEGVRRAVDAWGLKLVAQSPDLYSDTVSAIYVPDGFDSNALTDHAFNTYDVSFGVGLGQMNGRAFRIGHLGSLTDVMVLSGLGAIEMAMADLDYPIVLGSGVAAAQDYYRSGPSDSAKAAA

SEQ ID NO: 433 - protein, 396 aa, Paracoccus denitrificans DSM 413; identical to SEQ ID NO: 304

SEQ ID NO: 434 - protein, 396 aa, Roseivivax isoporae LMG 25204
MSMQNPVFIPGPTNIPEALRRACDMPTIDHRSPLFGQILHPARTGVRRVLKSDSAEIFLFPSTGTGGWETALSNTLSPGDGVLVARNGMFSARWIDMCERHGLEMTIIETPWGEGIPADRFEEALTADTGHRIKAVLATHNETATGVRSDIAAVRRAMDAAGHPAMLFVDGVSSIASMDFRFDEWGVDVAVTGSQKGFMLPPGLAILGFSQRALEARATATLPRTFFDTRDMERGYAANGYPYTPAVGLMNGLNIACDMLLSEGLEAVFARHHRIAEGVRAAVAAWGLKLCAVRPELQSDTVSAIRTPEGFDANRIVAHAAEAYGVAFGTGLGAVAGKVFRIGHLGSLTDVMALSGIATAEMVMADLGLPVTLGSGTAAAQEVYRATRATALKDAA

SEQ ID NO: 435 - protein, 396 aa, Citreicella thiooxidans DSM 10146
MSFQNPVFIPGPTNIPESLRKACDMPTIDHRSPLFGQILHPAREGVRKVLKSDAAEVFIFPSTGTGGWETALSNTLSPGDTVLAARNGMFSHRWIDMCQRHGLSVEIVETPWGEGLPAHRYAEILAADKQHRIKAVLATHNETATGVRSDIAAVRRALDDAGHPALLFVDGVSSIASMDFRFDEWGVDCAVAGSQKGFMLPPGLAIVGFSDKAMAATQTARLPRTFFDVQDMAKGYANNAYPYTPAVGLLNGLNEACRMLLDEGLENVFARHHRIAEGVRCAVRAWGLELCAASPEVYSDTVSAIRTPDGFNATDIVSHAAQTYGVAFGTGLGEVAGKVFRIGHLGSLTDVMTLSGLATAEMCMKDLGLDITLGSGVAAAQEFYRATPALARKAAA

SEQ ID NO: 436 - protein, 396 aa, Antarctobacter heliothermus DSM 11445
MSFQNPVFIPGPTNIPESLRKACDMPTIDHRSPLFGQILHPAREGVRNVLKSDSAEVFIFPSTGTGGWETALTNTLSAGDKVLSARNGMFSHRWIDMCQRHGLVVQIVETPWGEGVPADRYEEILTADKNHQIKVVLATHNETATGVKSDIAAVRRALDAAGHPALLFVDGVSSIGSMDFRFDEWGVDVAVTGSQKGFMLPAGLGIVGFSAKAMAATKTGTLPRTFFDVHDMAKGYANNAYPYTPAVGLLNGLNVACGMLLNEGLENVFARHTRIASGVRAAVSAWGLELCAATPSVYSDTVSAIRTPEGFNATDIVTHAADRYGVAFGVGLGEVAGKVFRIGHLGSLTDVMMLSGIATAEMCMADLGLDITLGSGVAAAQDYYRSHGVAAQKDAA

SEQ ID NO: 437 - protein, 398 aa, Nitratireductor sp. ZZ-1
MSTQNPIFIPGPTNIPERLRRAVDYPSIDHRSPAFAEMLKPAQDGVRRILRSKQAEIILFPSTGTGAWEAAITNTLSPGDKVLAARYGMFSHRWIDLCRRHGLEVEVIETPWGEGAPAEAFEEALKADAGHAIKAILVCHNETATGVVSDIAAVRRAIDAARHPALLYVDGVSSIASMDFRMDDWGVDIAITGSQKGFMLPAGLAILGIGPKAIQAVASAQCPRCFFDFRDMLKSNAGGGYPYTPPVNLIRGLSVSIAMLEEEGLPRVLARHHRIAEGVRRAVAAWGLSLCAQRPELYSDTVSAVVVPDGFDATRIVTHAAEKYGVAFGVGLGEVAGKLFRIGHLGSMTDVMALSGIATAEMVMADLGLPVTLGSGVAAAQEYYRTSRENAGSARAAA

SEQ ID NO: 438 - protein, 396 aa, Rhizobium sp. CNPSO 671
MYGQNPVFIPGPTNMPEILRKAADMPTMDHRSSMFGEILHPALAGVKQVLKSETASVFIFPATGSGGWETAITNTLSPGDRVLAGRHGMFSHKWIDMCRRYQLTVDAIESSWHDGVPLAQYEELLNGDKAHEIKAVLVTHNETATGVKSDVAAVRRLLNAANHPALLLVDGVSSIASMDFRMDEWGVDVAVTGSQKGFMLPVGLAITAFSAKAMAALETAKLPRAFFDVRDMAKGYSTNGYPYTPSVGLLNGLKVSTELLLQEGLENVFARHRRIASGVRAAVRAWRLELYAAREELYSETVTAVQTPAGFDASRFVTHAATKYDVAFGAGLGDVAGKVFRIGHVGSMTDVMALSGIATAEMVMVDLGLNIKLGSGVAAAQAIYRNSQSSASYMVA

SEQ ID NO: 439 - protein, 396 aa, Pseudomonas stutzeri NP_8HO
VSTQNPIFIPGPTNIPEVLRKAVDMPTIDHRSPMFGKILHPALEGVKKVLKSTQAQVFVFPSTGTGGWETAITNTLSEGDAVLATRNGMFSHRWIDMCQRHGLDVQIVDQSWGEGIPTDRFEEILTADTAHRIKAVLATHNETATGVRSDIAAIRRALDRAGHPAMLFVDGVSSIACYDFRMDEWGVDVAVTGSQKGFMLPPGLAIVGFSPKAMTAVEGASLPRTFFDIRDMARGYAANGFPYTPPVGLLNGLKVATDMLLDEGLENVFARHHRIAEGVRQAVAAWGMTLCAARPALYSDSVSAIRTPDGFDANRIVSHALKTYGVAFGTGLGDVAGKVFRIGHLGMLTDVMALSGLATAEMVMVDLGLPVTLGSGVAAAQAHYRHSAGQACRQAA

SEQ ID NO: 440 - protein, 396 aa, Ruegeria sp. ANG-R
MSNQNPVFIPGPTNIPDRLRLAMQVQTQDHRAPDFVETFGPVLEDTKQVFGTTKGQVVTFPASGTGGWEAAITNTLSPGDKVLVARYGVFSHRWIDLCERHGLNVQIVECPWGTGAPADRFEAILSADKAHEIRAVLVTHNETATGVLSDIGAVRRAMNAARHPAMLFVDCVSSLASMPFRFDQWGVDIAVSGSQKGFMLATGMAILCVSPKALAAMETARLPRTFFDFRDMMAANASGGFPYTPPLQLIYGMRESLKMLFEEGLDTVYARHHRLAEGVRRAVNAWGLKLVAQSPELYSDTVSAIYVPEGFDSNKLTDHAFDKYGVSFGIGLGEMNGKAFRIGHLGSLTDVMVLSGLATIEMAMADLNYPVNLGSGVAAAQEYYRAGSSSDAKAAA

SEQ ID NO: 441 - protein, 396 aa, Mameliella alba CGMCC 1.7290; identical to SEQ ID NO: 430

SEQ ID NO: 442 - protein, 397 aa, Pseudorhodobacter antarcticus CGMCC 1.10836
MTFQNPVFIPGPTNMPEHIRLACHMPTIDHRSPVFGKILHPCLEGVQRILKSTSAKVFIFPSTGTGGWEVALSNTLSKDGKVLAARNGMFSHRWIDMCQRHGLDVQIVETPWGHGLPADKYEEILRADKSHSIKVVLATHNETATGVKSDIAAVRRALDAANHPAMLFVDGVSSIGSMDFRMDEWGVDVAVTGSQKGFMLPAGLAIIGFSTKAMAAIDAATLPRTFFDVRDMAKGYANNAFPYTPPVGLMNGLKAAIEMIEGEGLENVFARHTRIATGVRHAVDAWGLKLCAAGPDVYSDTVSAICTPEGFNATDIVTVAARDYDMAFGVGLGEVAGKVFRIGHLGSLTDAMMLSGLATVEMVMVDLGLDIKLGSGVAAAQAHYRHGSNKSKRMAAE

SEQ ID NO: 443 - protein, 388 aa, Loktanella sp. DSM 29012
MSFQNPVFIPGPTNMPEHIRQACYMPTIDHRSPMFGKMLHPILDGVRRVMKSQSAHIFIFPSTGTGGWETALTNCLSAGDKVLAARNGMFSHRWIDMCQRHGLDVQIVETAWGDGLPADKYEEILKADTNREIKVVLATHNETATGVKSDIGAVRKALDAAEHPALLFVDGVSSIGSMDFRFDDWGVDVAVTGSQKGFMLPAGLAIVGFSDKAMKATETATLPRTFFDVKDMQKGYDNNAFPYTPPVGLMRGLEASLKLIEDEGLENVLARHTRIATGVRHAVDAWGLRLCANSPEVYSDSVSAIRTPEGFNATDIVTRSADKYGMAFGVGLGEVAGKVFRIGHLGLLTDAMMLSGLGVAEMVMVDLGLDIKLGSGVAAAQEFYRHGS

SEQ ID NO: 444 - protein, 396 aa, Paracoccus thiocyanatus ATCC 700171
MTSQNPIFIPGPTNIPEEMRKAVDMPTIDHRSPVFGRMLHPALEGVKKVLKSTQAQVFLFPSTGTGGWETAITNTLSPGDKVLAARNGMFSHRWIDMCQRHGLDVTFVETPWGEGIPADRFEEILTADKGHEIRAVLATHNETATGVKSDIAAVRRALDAAKHPAMLFVDGVSSIGSMDFRMDEWGVDIAVTGSQKGFMLPPGLAILGFSPKAMAAVESARLPRTFFDIGDMGEGYARNGYPYTPPVGLINGLNASCERILAEGLENVFARHHRIAGGVRAAVGAWGLKLCAARPELYSDSVSAIRVPEGFDANLIVSHALDTYDMAFGTGLGQVAGKVFRIGHLGSLTDAMALAGLATAEMVMADLGLPIRLGSGVAAAQDHYRQTTAAALKKAA

SEQ ID NO: 445 - protein, 392 aa, Rhodovulum sulfidophilum TUT; identical to SEQ ID NO: 361

SEQ ID NO: 446 - protein, 395 aa, Roseovarius sediminilitoris DSM 29439
MSFQNPVFIPGPTNMPESLRKAVDMPTLDHRSPLFGQILHPALEGVKKVLKSETAKVFIFPSTGTGGWETALTNTLSAGDKVLAARNGMFSHRWIDMCQRHGLDVQIVETPWGAGLPADKYADILKVDADHEIKVVLATHNETATGVRSDIAAVRKALDAANHPAMLFVDGVSSIASMDFRMDEWGVDIAVTGSQKGFMLPAGLAIVGFSPKAMAALETATLPRTFFDVRDMGNGYANNAYPYTPAVGLLNGLNEACKMLLDEGLENVFARHHRIAEGVRQAVSAWGLELCAVSKDVQSDTVSAIRTPEGFNATDIVTHAANKYGVAFGVGLGEVAGKVFRIGHLGSLTDVMTLSGLATAEMCMVDLGLDIKLGSGVAAAQEYYRANQLAMSKAA

SEQ ID NO: 447 - protein, 396 aa, Leisingera sp. ANG-M1
MSFQNPVFIPGPTNMPEALRKAVDMPTLDHRSPLFGQILHPALAGVKKVLKSENAEIFVFPSTGTGGWETAITNTLSAGDKVLAARNGMFSHRWIDMCQRHGLEVQVVETPWGEGLPADRYEEILTADTAHEIKVVLATHNETATGVKSDIAAVRRVLDAAGHPALLFVDGVSSIASMDFRMDEWGVDIAVTGSQKGFMLPPGLAIVGFSPKAMQAVKTASLPRTFFDIKDMALGYSNSAYPYTPSVGLLNGLNMACGMLLEEGLENVFARHHRIAEGVRSAVRAWGLELCAVSPEVYSDSVSAIRTPDGFDANKFVSLAAEKYGVAFGTGLGEVAGKVFRIGHLGSLTDVMALSGIATAEMVMADLGLNIPLGSGVAAAQDYYRGNTAASTKAAA

SEQ ID NO: 448 - protein, 397 aa, Roseovarius azorensis DSM 100674
MSDQNPVFIPGPTNIPDRLRRAMQVQTQDHRSPAFVNTLAPVLEGCKTVFGTTVGQIITFPASGTGGWEAAITNTLSPGDKVLVARYGMFSHRWIDMCQRHGLSVEIIECAWGSGAPADRFEEALKADNGHAIKAVLVTHNETATGVRSDIAAVRRAIQEADHPALLMVDCVSSLASMPFEMDKWGVDIAVSGSQKGFMLNTGMAILAVSPKALATMERAQLPRTFFDFRDMMSANGKGGFPYTPPLQLIYGMAESLDMLFEEGLDNVYARHTRLAEGVRRAVSGWGLRLVAQSPDLYSDTVSAVYVPEGFDSNALTEHAFANYGVSFGVGLGEMNGRAFRIGHLGSLTATMVLSGLATLEMAMADLKYPVRLGSGVIAAQEYYRATAKSTLTERAA

SEQ ID NO: 449 - protein, 396 aa, Sulfitobacter pseudonitzschiae DSM 26824
MSFQNPVFIPGPTNIPENLRKACDMPTIDHRSPLFGQILHPARAGVQKVLKSTSAEVFIFPSTGTGGWETALTNTLSAGDTVLAARNGMFSQRWIDMCQRHGLNVNVVETPWGQGVPADRYAEILAADTGHQIKAVLATHNETATGVRSNIAAVRQALDDAGHPAMLFVDGVSSIGSMEFRFDDWGVDVAVTGSQKGFMLPAGLGIVGFSAKAMEATKSAKLPRTFFDVHDMAKGYANSAYPYTPAVGLLNGLNTACGMLLDEGLANVFARHHRIAEGVRAAVGAWGLDLCAASPDLYSDTVSAIRTPEGFNATSIVTHAAEVYGVAFGVGLGEVAGKVFRIGHLGSLTDVMMLSGIATAEMCMADLGLDITLGSGVAAAQDYYRANRAERQQDAA

SEQ ID NO: 450 - protein, 396 aa, Ruegeria sp. CECT 5091
MSNQNPVFIPGPTNIPDRLRLAMQVQTQDHRAPDFVETFSPVLEDTKKVFGTKEGKIITFPASGTGGWEASVTNTLSPGDSVLVARYGMFSHRWIDLCQRHGLDVRIIECPWGSGAPADKFAEALAADKEHKIRAVLVTHNETATGVRSDIGAVRGAMDASDHPAMLFVDCVSSLASMPFEFDGWGVDIAVSGSQKGFMLATGMAILCVSPKALAAMETAQLPRTFFDFRDMMNANASGGFPYTPPLQLIYGMRESLKMLFEEGLNNVYARHFRLAEGVRKATAAWGLELVAQSPELYSDTVSAIYVPDGFDSNALTDHAFNAYGVSFGIGLGEMNGKAFRIGHLGSLTDVMVLSGLATIEMAMADLDYPIKLGSGVAAAQEYFRTSSATPMQSAA

SEQ ID NO: 451 - protein, 396 aa, Pseudoruegeria haliotis DSM 29328
MSFQNPVFIPGPTNMPEAVRQACYMPTIDHRSPTFGKILHPCLDGVRKVLKSDSAHIFIFPSTGTGGWETALTNTLSKGDKVLAARNGMFSHRWIDMCQRHGLDMQIVESPWGNGLPADHYEEILRADTGHKIKVVLATHNETATGVKSDIAAVRRALDAAGHPAMLFVDGVSSIASMDFRFDEWGVDVAVTGSQKGFMLPAGLAIVGFSDRAVAASKTAELPRTFFDIKDMQNGYNASAFPYTPPVGLMNGLKLSLDMLLSEGLENVFARHHRIAEGVRAAVRAWGLELCATSPDVYSDTVSAIRTPEGFNATDIVTHAADTFGVAFGVGLGEVAGRVFRIGHLGSLTDVMTLSGLGAAEMCMADLGLNIPLGSGVAAAQEYYRSHPSAALKSAA

SEQ ID NO: 452 - protein, 387 aa, Psychrobacter sp. ENNN9_III
MSLQNPIFIPGPTNIPDRLRRAMNVPTQDHRAPDFSDTFLPVLADCKKVFGTQDGEIILFTSSGTGGWEAAISNTLSPGDKVLIARYGMFSHRWIDMCQRHGLDVQIVECAWGTGAPADQFQAILSEDTAHEIKAVMVTHNETATGVLSDIGAVRKAMDSSDHPALLFVDGVSSIASVPFEMDDWGVDIAVAGSQKGFMLATGMAILGVSQKALSHMDEAKLPRTYFDFRDMLKANANGGFPYTPPLNLIYGMRASLDMLFEEGLENVYARHHRLAEGVRQAVSAWGFKLCAASPDLYSETVSAIYVPEGFDSNELTDHAFNKYGISFGIGLGEMHGKAFRIGHLGSLTEVMVLAGLATIEMAMVDLDYPIKLGQGVAAAQEYYRNN

SEQ ID NO: 453 - protein, 399 aa, Pararhodobacter aggregans DSM 18938
MTAHQAFAQNPVFIPGPTNMPEALRKACDVPTLDHRSPAFARMLAPALAGVKRVMGMESGEVFLLPATGTGGWEAAIANTLSPGDRVLAARYGVFSARWIDLCQRFGLEVEVLDTPWGEGLPLERIEAALRADRTGRIKTVLATHNETATGVRSDIAGLRRAMDRAGHEALMMVDGVSSIASMPFDFSGWGVDIAVTGSQKGFMLPPGLAILGLSDRALAAMENARLPRTYFDLKDMRRSMAAGGYPYTPPVGLIAGLAASVAMLEDEGLAAVHARHYRLAEGVRRAVAGWGLSTCAAGPALASDTVTAVLAPEGCDANAFVARAAGTYGMAFGTGLGQLAGKAFRIGHLGMLSDPLMLAGLATAEMVMADLGWPVRLGSGVVAAQDFYRGALPLAAAA

SEQ ID NO: 454 - protein, 392 aa, Rhodovulum kholense DSM 19783
MHALNPIFLPGPTNLPEALRRACDIPTMDHRSAAFGPILASAMAGVKQVLGLSEGEVAIFPATGTGGWEAAVTNTLRPGDKVLAARHGMFSRKWIDLCQRHGLDVEIVERPWGEGVPVEAFAAALAADTGHRIRAVLVTHNETATGVTSDVAAVRAAMTAAGHPALLMVDGVSSIGSIDFRMDAWGVDLAVTGSQKGFMLPAGLAIVGIGPKALAAMETSGLPRCFFDIRDMLGGNYPYTPPVGLINGLAVSTGLLLEEGMEAVRARHHRIAEGVRRAVAAWGMTTCAARPELCSDTVTAIVTPDGVDAGRIVRHAAEAYGVAFGGGLGEVADKVFRIGHLGLMSDVMALSGIATAEMAMTDLGLPVRLGSGVAAAQEHYRNSRTAPVRAAA

SEQ ID NO: 455 - protein, 396 aa, Rhizobium yanglingense LMG 19592
MYTQNPVFIPGPTNMPEVLRRATDLPTIDHRSAAFADILQPALAGVRKVVKSENAEIVVFPATGSGGWEATITNLLSPGDKVLAARCGMFSHRWIDMCQRHGLQVDTVHSSWQQPLPLAEYEKRLFADKGHDIKAVLVTHNETATGVKSDVGAVRRLLDDAKHPALLLVDGVSSIASMDFRMDEWKVDAAITGSQKGFMLPVGLAILALSPKAMQAAQSAKLHRAYFDIREMAKTYPSSGYPYTPSVGLLNGLKMSTELLLGEGLDNVFKRHARIASGVRAAVSAWGLRLYAQEESSFSDTVSAVETPDGFDATSIVTHAAQKYAVAFGAGLGDVAGRVFRIGHLGSMSDVMALSGIATAEMAMADLGLPIRLGSGVAAAQEIYRNSAASAIRNAA

SEQ ID NO: 456 - protein, 396 aa, Labrenzia sp. C1B70; identical to SEQ ID NO: 417

SEQ ID NO: 457 - protein, 396 aa, Ruegeria mobilis 45A6
MSFQNPVFIPGPTNIPESLRKACDMPTIDHRSPLFGQILHPARDGVRKVLKSETAEVFIFPSSGTGGWETALSNTLSAGDTVLAARNGMFSHRWIDMCQRHGLEVQIVETPWGAGLPADRYEEILSADKAHKIKAVLATHNETATGVKSDIAAVRRALDAAGHPALLFVDGVSSIASMDFRMDEWGVDVAVTGSQKGFMLSAGLAIVGFSPKAMEATKSAQLPRTFFDVHDMAKGYANNAYPYTPAVGLMNGLNESCKMLLAEGLENVFARHHRVAEGVRAAVGAWGLELCAATPEVYSDTVSAIRTPEGFNATDIVTHAADKYGVAFGLGLGEVAGKVFRIGHLGSLTDVMALSGIATAEMCMVDLGLDIQLGSGVAAAQEYYRGNAVSAQQDAA

SEQ ID NO: 458 - protein, 395 aa, Oceaniovalibus guishaninsula JLT2003
MSFQNPVFIPGPTNMPEAIRQACYMPTIDHRSPVFGRILHPCLDGVRRVLKSESAHIFIFPSTGTGGWETALTNTLSPGDTVLAARNGMFSHRWIDMCQRHGLTVQVIETPWGEGIPAGKMEEALRADKDRAIKVVLATHNETATGVKSDIAAVRRALDAAGHPAMLFVDGVSSIASMDFRFDEWGVDVAVTGSQKGFMLPAGLAIVGFSEKAMNAVETARLPRTFFDVRDMARGYANNAFPYTPPVGLMNGLKLSLQMIEDEGLENVFARHRRIATGVRRAVDAWGLELCAVSPDVQSDTVSAIRTPEGFNATDIVTVAARDYGMAFGVGLGEVAGKVFRIGHLGSLTDAMMLSGLGTAEMVMVDLGLPIKLGSGVAAAQDVYRRGGEARKAAA

SEQ ID NO: 459 - protein, 396 aa, Loktanella vestfoldensis DSM 16212
MSFQNPVFIPGPTNMPESIRKACDMPTIDHRSPLFGQILHPARANVQKVLKSDSAEVFIFPSTGTGGWETAITNTLSAGDTVLAARNGMFSHRWIDMCQRHGLDVQIVETPWGHGLPADRYADALQADKAHKIKAVLATHNETATGVKSDIAAVRAALDAADHPALLFVDGVSSIGSMDFRFDDWGVDIAVTGSQKGFMLPAGLAILGFSAKARAATKTAGLPRTFFDVNDMAKGYDNSAFPYTPPVGLMNGLLLASDMLLREGLDNVFARHTRIASGIRAAVHAWGLDLCAATPDLYSDTVSAINTPAGFNATQIVNHAASAYGVAFGTGLGEVAGKVFRIGHLGSMTDVMALSGIATAEMCMVDLGLDIKLGSGVAAAQEHYRRTTGQALKDAA

SEQ ID NO: 460 - protein, 396 aa, Rhizobium etli bv. mimosae Mim1
MYTQNPVFIPGPTNMPEVLRRAADLPTIDHRSAAFADILQPALAGVRKVVKSEDAEIIVFPATGSGGWEAAITNLLSPGDKVLAARHGMFSHRWIDMCQRHGLQMDVAHSSWKHPLPLAEYEKRLVADKGHDIKAVLVTHNETATGVKSDVGAVRRLLDEAGHPALLLVDGVSSIASMDFRMDQWKVDAAITGSQKGFMLPVGLAILALSAKAMQAVQSAKLRRGFFDIREMAKSYPASGYPYTPSVGLLNGLKVSTELLLGEGLDNVFKRHARIASGVRAAVSAWGLRLYAQEASSFSDTVSAVETPEGFDATSIVTLAAQKYGVAFGAGLGDVAGRVFRIGHLGSMSDVMALSGIATAEMAMADLGLPIRLGSGVAAAQEIYRNTAASPVRKAA

SEQ ID NO: 461 - protein, 396 aa, Methylobacterium komagatae DSM 19563
MFAQNPVFIPGPTNMPEVLRRAADMPTLDHRSPYFAQILHPALAGVKKVLKSETAEVFIFPSTATGGWETALSNTLSVGDAVLASRYGMFSHRWIDMARRHGLDVRVIEAPWGQGLPADRFAEALSADKAHRIKAVLVTHNETATGVKSDVAAVRRALDATGHPALLLVDGVSSIASMDFRMDEWGVDVAVTGSQKGFMLPAGLAITAFSPKAMDATATATLPRTYFDIRDMAKGYANGAYPYTPSVGLLNGLKLSTELLLAEGLDAVFARHRRIADGIRAAVSAWGLELCAARPELYSDTVSAIRTPEGFDATQIVTHAARQYDVAFGVGLGEVAGKVFRIGHLGSLTDVMALSGIAAAEMAMADCGLRIELGSGVAAAQAVYRGAAGTRLRAAA

SEQ ID NO: 462 - protein, 396 aa, Rhizobium tropici YR635
MYMQNPVFIPGPTNMPEILRKAADMPTLDHRSPLFGQILRPALAGVKKILKTEAASVYVFPSTGTGGWETAITNTLSPGDRVLAARYGMFSQRWIDMCQRHGLKVDIIEAAWGGGAPAARYEEILAADTAHEIKAVLVTHNETATGVKSDIAAVRRAIDAARHPALLFVDGVSSIASMDFRMDEWLVDIAVTGSQKGFMLPAGLAITAFSPKALAAVETAKLPRTFFDIGDMARSYANNAYPYTPAVGLLNGLKLSTELLLAEGLENVFARHRRIASGIRAAVRAWGLELCAMSEDLYSDTVSAIRTPEGFDATSIVAHAAKTYDVAFGVGLGEVAGKVFRIGHLGSLTDVMALSGIATAEMVMVDLGLDIKLGSGVAAAQDYYRDGRASKVRAAA

SEQ ID NO: 463 - protein, 396 aa, Aurantimonas altamirensis DSM 21988
MYMQNPVFIPGPTNMPEVLRRAADMPTLDHRSPRFAEILHPALAGVRKVIKGASSEVFVFPSTGTGGWETAITNTLSPGDTVLAARFGMFSHRWIDMCRRHGLNVELVEEAWGNALPIEAYEARLRADRQHRIKAVLATHNETATGVRSDIAAVRRALDAANHPAMLFVDGVSSIASMDFRMDEWGVDIAVTGSQKGFMLPVGLAIVACSPRAMDVMADAKLPRTFFDIADMRARYADGAYPYTPSVGLLNGLKLATEMLLTEGLDNVFARHRRIAEGVRAAARAWAMPLCATRPEIASDTVTAVMTPQGFDATRLVAHASTKYDVAFGVGLGEVSGKLFRIGHLGSLSDVMALSGIATAEMAMADLGLPITLGSGVAAAQEHYRSTQAAEARLAA

SEQ ID NO: 464 - protein, 396 aa, Sulfitobacter sp. MCCC 1A00686; identical to SEQ ID NO: 449

SEQ ID NO: 465 - protein, 396 aa, Methylobacterium sp. 13MFTsu3.1M2
MFAQNPVFIPGPTNMPEVLRRAADMPTLDHRSPLFAQILHPALAGVKKVLKSEDAEVFIFPSTATGGWETALSNTLSAGDTVLAARHGMFSHRWIDMTRRHGLDVRMIEAPWGEGLPADRFAEALAADKAHRIRAVLVTHNETATGVRSDVAAVRRALDASNHPALLLVDGVSSIASMDFRMDEWGVDVAVTGSQKGFMLPAGLAIVAFSPKAMAATATATLPRTYFDIRDMAKGYPNGAYPYTPAVGLLNGLKLSTELLLAEGLETVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMVDLGLRIALGSGVAAAQAVYRRAPAAALRAAA

SEQ ID NO: 466 - protein, 396 aa, Methylobacterium sp. 275MFSha3.1; identical to SEQ ID NO: 355

SEQ ID NO: 467 - protein, 396 aa, Paracoccus pantotrophus DSM 11073; identical to SEQ ID NO: 344

SEQ ID NO: 468 - protein, 396 aa, Marinovum algicola DSM 10251
MSFQNPVFIPGPTNIPENLRKACDMPTIDHRSPLFGQILHPAREGVRKVLKSDSAEVFIFPSTGTGGWETALTNCLSAGDKVLSARNGMFSHRWIDMCQRHGLDVQIVETPWGEGLPADRFEEILTADTNHEIKAVLATHNETATGVKSDIAAVRKALDAAGHPALMFVDGVSSIGSMDFRFDEWGVDVAVAGSQKGFMLMAGLAIVGFSEKAMAATQTATLPRTFFDVHDMKKGYANSAYPYTPAVGMLNGLNQACTMLLDEGLENVFARHHRIAEGVRAAVGAWGLELCAASPDLYSDTVSAIRTPEGFNATDIVSHAASKYGVAFGVGLGEVAGKVFRIGHLGSLTDVMTLSGLATAEMCMADLGLDITLGSGVAAAQEYYRGHAVAARKSAA

SEQ ID NO: 469 - protein, 396 aa, Paracoccus versutus DSM 582
MTSQNPIFIPGPTNIPEEMRKAVDMPTIDHRSPVFGRMLHPALEGVKKVLKTTQAQVFLFPSTGTGGWETAITNTLSPGDKVLAARNGMFSHRWIDMCQRHGLDVTFVETPWGEGIPADRFEEILAADKGHEIRVVLATHNETATGVKSDIAAVRRALDAAKHPAMLFVDGVSSIGSMDFRMDEWGVDIAVTGSQKGFMLPPGLAIVGFSPKAMAAVESARLPRTFFDIRDMATGYARNGYPYTPPVGLINGLNASCERILAEGLENVFARHHRIAGGVRAAVEAWGLKLCAARPELYSDSVSAIRVPEGFDANLIVSHALETYDMAFGTGLGQVAGKVFRIGHLGSLTDAMALSGIATAEMVMADLGLPIKLGSGVAAAQEHYRQTTAAAQKKAA

SEQ ID NO: 470 - protein, 396 aa, Thalassobius aestuarii DSM 15283
MSFQNPVFIPGPTNIPESLRKACDMPTIDHRSSLFGQILHPARAGVRKILKSETAEVFIFPSTGTGGWETALTNCLSSGDKVLAARNGMFSHRWIDMCQRHGLDVQVVETPWGEGLPADRYEEILTADTAHKIKVVLATHNETATGVKSDIAAVRRALDAAGHPALLFVDGVSSIASMDFRMDEWGVDVAVTGSQKGFMLTAGLAIVGFSAKAIEATKSATLPRTFFDINDMTAGYANNAYPYTPAVGLLNGLNEACAMLLNEGLENVFARHHRIAEGVRAAVGAWGLELCAANPSVYSDTVSAIRTPDGFNATDIVTHAASKYGVAFGVGLGEVAGKVFRIGHLGSLTDVMALSGIATAEMCMVDLGLDVRLGSGVAAAQEYYRGHGIEAQKDAA

SEQ ID NO: 471 - protein, 396 aa, Litoreibacter janthinus DSM 26921
MSFQNPVFIPGPTNMPECLRRACDMPTLDHRSSLFAEILHPARDGVRQVMKASDAEIFIFPSTGTGGWETAITNTLSRGDTVLAARNGMFSQKWIDMCQRHGLNVKIVEAAWGEGIPTDQFEEILTADKNHQIKAVLATHNETATGVLSDIAGVRAAMSAAQHPALLFVDGVSSIGSMDFRFDDWGVDVAVTGSQKGFMLPAGLGIAGFSRKAMDAAKTAGLPRTYFDIRDMSKGYAANAYPYTPAVGLLNGLKLACGMLLDEGLDAVFARHARIANGVRGAVEAWGLELCAVRPELYSDTVSAIRTPEGFDAGRIVSHASQNYRVAFGVGLGLVAGKVFRIGHLGSLTDVMTLSGIATAEMVMADLGLDITLGSGVAAAQEIYRSTAAPMVLAAE

SEQ ID NO: 472 - protein, 396 aa, Paracoccus sp. 361
VSTQNPIFIPGPTNIPEVLRKAVDMPTIDHRSPMFGKILHPALEGVKKVLKSTQAQVFVFPSTGTGGWETAITNTLSAGDAVLATRNGMFSHRWIDMCQRHGLDVQIVDQSWGEGIPTDRFEEILTADTAHRIKAVLATHNETATGVRSDIAAVRRALDRAGHPAMLFVDGVSSIACYDFRMDEWGVDVAVTGSQKGFMLPPGLAIVGFSPKAMTAVEGAGLPRTFFDIRDMARGYAANGFPYTPPVGLLNGLKVATDMLLDEGLENVFARHHRIAEGVRQAVAAWGMTLCAARPTLYSDSVSAIRTPDGFDANRIVSHALNTYGVAFGTGLGDVAGKVFRIGHLGMLTDVMALSGLATAEMVMVDLGLPVTLGSGVAAAQAHYRHSAGQACRQAA

SEQ ID NO: 473 - protein, 396 aa, Paracoccus homiensis DSM 17862
MSFQNPVFIPGPTNIPESLRKACDMPTIDHRSPLFGQILHPAREGVRKILKSASAEVFIFPATGTGGWETALTNTLSAGDKVLAARNGMFSHRWIDMCQRHGLQVEIVETPWGQGLPADRYADILAADTAHQIKAVLATHNETATGVKSDIAAVRRALDDAGHPAMLFVDGVSSIGSMDFRFDEWGVDIAVTGSQKGFMLPAGLAIVGFSEKAMAATQTGTLPRTFFDVHDMAKGYANNAYPYTPAVGLLNGLNQSCTMLLAEGLENVFARHRRIAQGVRAAVEAWGLPLCAAHPSLYSDTVSAIRTPEGFNATDIVTHAAEKYGVAYGVGLGEVAGKVFRIGHLGSLTDVMALSGIATAEMCMADLGLDIKLGSGVAAAQDFYRGNPAIACKDAA

SEQ ID NO: 474 - protein, 396 aa, Ponticoccus sp. UMTAT08
MTDQNPVFIPGPTNMPDRLRRAIQIQTRDHRAPDFVDTFAPVLEDTKKVFGSTEGKIITFPASGTGGWEAAVTNTLSPGDKILVGRYGVFSNKWIDLCQRHGLDVQIVETPWGEGVPADKFAEILAADTAHEIKAVLTTHNETATGVRSDIAAVRRALDGADHPAMLFVDCVSSLASMPFEFDAWGVDIAVSGSQKGFMLPTGMAILCVSPKALAAIETAGLSRTFFDFRDMMKANATGGFPYTPPLQLIYGLRESLDMLFEEGLENVYARHFRLAEGVRRAVDAWGMKLVAKSPDLYSDTVSAVYVPEGFDSNALTDHAYRAYKVSFGVGLGQLDGKAFRIGHLGSLTDVMVLSGLATIEMAMADLNYPITLGSGVAAAQEYYRTSRVAALKSAA

SEQ ID NO: 475 - protein, 404 aa, Marinobacter psychrophilus 20041
VTGLLVIAITERERLMSDQNPIFIPGPTNIPDRLRFAMNVQSSDHRSPGFVETLSPLLQDCKKVFNTQSGEVILFPASGTGGWEAAICNTLSPGDKVLIARYGMFSRRWIDMCQRHGLDVQIIECPWGSGAPANEFKRALSADTQHKIKAVLVVHNETATGVKSDIDAVRQAMDSCSHPALLLVDCVSSLASMPFEMDNWGVDIAVSGSQKGFMLITGMAILAVSQKALAEMETAKLSCAFFDFRAMMTANAQGGFPYTPPLQLICGLKESLKMLFEEGLDNVYARHFRLAEGVRQATHAWGMALCAQSPDLYSNTVTAIYVPEGFDSNELTDHTLAKYGVSFGIGLGEMHGKAFRIGHLGSLTDSMVLSGLATIEMAMADLDYPIELGSGVRAAQNHFRATTA

SEQ ID NO: 476 - protein, 396 aa, Methylobacterium sp. Leaf361; identical to SEQ ID NO: 355

SEQ ID NO: 477 - protein, 396 aa, Aestuariivita boseongensis BS-B2
MSFQNPVFIPGPTNIPEVIRKACDMPTIDHRSPLFATILHPALDGVRAVMKQTKGETFIFPASGTGGWETALSNTLNPGDTVLAARNGMFSHKWIDMCQRFGLKVRQVDVTWGEGLPVATFEEILRDDTAGEIKAVLATHNETATGVVSDVGGLRRAMDAAGHGALLLVDGVSSIGSMDFQFDDWGVDVAVTGSQKGFMLPAGLAIVGFSEKAVAASKTNSLPRTFWSIDDMRNGYAANAYPYTPAVGLMNGLKLATEMLLGEGLDNVFARHARIAEGVRAATFAWGMKPCAVSPDLYSNTVTAIRTPEGFNASDIVARAAQEYGMAFGTGLGDVAGKVFRIGHLGSLTDAMALSGIATAEMVMADLGLPIQLGSGVAAAQEIYRHGNTSQRMAAQ

SEQ ID NO: 478 - protein, 396 aa, Paracoccus isoporae DSM 22220
MSFQNPVFIPGPTNIPESLRKACDMPTIDHRSPLFGQILHPALAGVRKVLKSDQAEIFIFPSTGTGGWETALTNTLSPGDKVLAARNGMFSHRWIDMCQRHGLEVQIVETPWGHGLPADRYEEFLTADKNHEIKVVLATHNETATGVRSDIAAVRRALDAAGHPAMLFVDGVSSIASMDFRFDEWGVDIAVTGSQKGFMLPPGLAILGFSKKAMAAIDSATLPRTFFDVRDMGKSYGNNAYPYTPAVGLLNGLNQACGMLLDEGLENVFARHHRIAEGVRAAIAAWGLELCAVSPDVYSDTVSAVRTPEGFNATDIVTHAASNYGVAFGVGLGEVAGKVFRIGHLGSLTDVMTLSGIATAEMCMADLGLDISLGSGVAAAQEYYRSTQSAARKDAA

SEQ ID NO: 479 - protein, 396 aa, Aminobacter aminovorans KCTC 2477
VTSQNPIFIPGPTNIPEVLRKAVDIPTVDHRSPLFAKILHPALDGVKKVMKTGRAEIIVFPSTGTGGWEAAITNTLSPGDKVLATRNGVFSHRWIDMCQRHGLDVVVVAQQWGDGIPADRLAEILAADKSHEIKAVLATHNETATGVRSDIAAVRGALDAAGHPAMLFVDGVSSIGSMDFRMDEWGVDIAVTGSQKGFMLPPGLAIVGLSPKAMESVADGRLPRTFFDVRDMISNYSAGGFPYTPPAGLLNGLKTATEMLLDEGLENVFARHRRIAEGVRRAVDAWELHLCAMRPELYSDTVSAIRVPDGFDANRIVAHALNAYGVSFGTGLMELAGKVFRIGHLGSLTEVMALSGIATAEMAMADLGLAVRLGSGVAAAQEHFRLGAAYARQKAA

SEQ ID NO: 480 - protein, 396 aa, Aminobacter aminovorans KCTC 2477
MAGFNQLFVPGPTNVPESVRQAMNMPMEDMRAPDYPTFTRGLFTDLMKVFRNETGRAFIFPSSGTGAWESAITNTLSPGDRVLMSRFGQFSHLWVDMAERFGLDVDVVDVEWGTGVPVEIYAERLAADKEHRIKAVFVTHNETATGVTSDVGAVRAALNAAKHPALLFVDGVSSVGSIDFRQEEWGVDCAVSGSQKGFMLPPGLGFLSVSQKALNAAKTAKFSRCYFSFEDQIRANDTGYFPYTPAVQLLRGLRAALDLIQEEGLDNIFERHHRLATGVRKAVDAWGLRVCAKEAKWNSDTVSAIVVPEGIDSADIVRRAYNGYQTSLGVGLNKVAGKVFRIGHLGWVNEVMMCGAISAAEMSLRDCGVKVQPGSGVGAALEHYRLSAQPAVAKAA

SEQ ID NO: 481 - protein, 396 aa, Aminobacter aminovorans KCTC 2477
MSSQNPIFIPGPTNIPEVLRKAVDMPTIDHRSPLFGKILHPALDGVKKVLKTTQAEVFAFPSTGTGGWEMAISNTLSAGDKVLATRNGMFSHRWIDMCQRHGLDVTVVTQNWGEGIPANIFEEMLVADKAHEIKAVLATHNETATGVRSDIAAVRRALDAAGHPALLFVDGVSSIGCMDFRMDEWRVDVAVAGSQKGFMLPPGLAIVACSSLALAAAETAGLHRTFFDLRDMAKGYANSGYPYTPPVGLLNGLKLSTEMLLEEGIENVFARHHRIACGVRAAVAAWGLRLCAGRPELYSDTVSAIRVPEGFDANKIVSHALNAYGVAFGTGLGDVAGKVFRIGHLGSLTEVMALAGVATAEMVMVDLGLPITLGSGVAAAQQHYRQSIGSPQLKAA

SEQ ID NO: 482 - protein, 397 aa, Loktanella litorea DSM 29433
MSFQNPVFIPGPTNMPEAIRKACDMPTIDHRSPLFGQILHPVRANVREILKSTSAEIFIFPSTGTGGWETAITNTLSPGDTVLAARNGMFSHKWIDMCQRHGLNVMMVETAWGQGIPTDRFAEILADDKDHKIKAVLATHNETATGVRSDIAGVRRAMDTSNHPAMLFVDGVSSIASMDFRFDEWGVDVAVTGSQKGFMLPAGLAIVGFSKRAVEATKTAGLHRTFFDINDMTKGYDANAYPYTPAVGLMNGLLLATETLLKEGMENVFARHNRIASGVRAAVDAWGLELCAASPDLYSDTVSAIMTPEGFNASDIVSHAAEKYGVAFGTGLGDVAGKVFRIGHLGSMTDVMALSGIATAEMCMVDLGLDIKLGSGVAAAQEFYMGKTQTVPMKDAA

SEQ ID NO: 483 - protein, 392 aa, Marinobacterium lutimaris DSM 22012
MSDQNPVFIPGPTNIPDRLRNAMHIQTRDHRAPDFVETFAPVLEDCKRVFGTETGQVITFPASGTGGWEASICNTLSAGDTVLVARYGMFSHRWIDLCQRHNLEVQVIDCEWGSGAPADLFEQALKADTEKTIKAVLVTHNETATGVKSDIAAVRRAMDAASHPAMLFVDCVSSLASMPFHMDDWGVDIAVSGSQKGFMLATGMAILGVSQKALAAMETATLPRTFFDFRDMMAANASGGFPYTPPLQLIYGMRESLKMLLEEGLDNVYARHFRLAEGVRKAVEAWGMKLCAQSPELYSDTVSAIYVPEGFDSNELTEHAFNAYGVSFGIGLGEMNGKAFRIGHLGSLTDVMVLSGLASIEMAMADLNYPIELGSGVRAAQEYYRATAAANQ

SEQ ID NO: 484 - protein, 397 aa, Rubrimonas cliftonensis DSM 15345
MQGQNPVFIPGPTNIPDRLRHAMNMQTLDHRAPDFVDLLTPVRAGLKKVLKTETAEVVTFPGSGTGGWEAAVSNTLSPGDTVLAARYGMFSHRWIELCQRLGLTVQVIETPWGEGAPADRIEEALAADKGHAIKAVLATHNETATGVRSDIAAVRRAMDAAGHPAMLYVDGVSSIASMDFRMDEWGVDLAVTGSQKGFMLYTGMAIVGVSRKALQAMETAACPRAYFDFRDMIGANAKGGYPYTPPLQLLFGLGESLKMLLDEEGLDAVFARHHRMAEGVRRAVAAWGMKLCANRPELCSDTVSAIYVPEGFKSDALVNHAFRTYGMSFGVGLGEMAGRAFRIGHLGSLTPSMALSGIATVEMAMADLNYPITLGAGVAAAQDYYRTTAGVPQQKAA

SEQ ID NO: 485 - protein, 388 aa, Planktotalea frisia SH6-1 (PFRI)
MSFQNPVFIPGPTNMPEEIRLATYMPTIDHRSPVFGGILHPCLDGVRRVLKSETAHIFIFPSTGTGGWETTLTNTLSAGDKVLVARNGMFSHRWIDMCERHGLDVQVVDVAWGEGLPVAEYAAILKADKDHTIKAVLATHNETATGVKSDIAGVRGALDAANHPALFFVDGVSSIGSMDFRMDEWGVDVAVTGSQKGFMLPAGLAIVGFSEKARAAVESATLPRTFFDIRDMEKGYAANAFPYTPPVGLMNGLKCAIEMIEAEGLENVFARHTRIATGVRHAVEAWGLELCANAPELYSDSVSAIRTPEGFNATDIVTRADEQYGMAFGVGLGDVAGKVFRIGHLGMLTDAMMLSGLGVAEMVMKDLGLDIKLGSGVGAAQEFYRYGS

SEQ ID NO: 486 - protein, 396 aa, Aureimonas altamirensis ON-56566
MYMQNPVFIPGPTNMPEVLRRAADMPTLDHRSPRFAEILHPALAGVRKVIRSASAEVFVFPSTGTGGWETAITNTLSPGDTVLAARYGMFSHRWIDMCRRHGLNVELVEEAWGNALPVEAYEARLRADRQHRIKAVLATHNETATGVRSDIAAVRRALDAANHPAMLFVDGVSSIASMDFRMDEWGVDIAVTGSQKGFMLPVGLAIVACSPRAMDMMADAKLPRTFFDIADMRARYADGAYPYTPSVGLLNGLKMATEMLLTEGLDNVYARHRRIAEGVRAAARAWAMPLCATRPEIASDTVTAVMTPQGFDATRLVAHASAKYDVAFGVGLGEVSGKLFRIGHLGSLSDVMALAGIATAEMAMADLGLPITLGSGVAAAQEHYRSTQAAEDRLAA

SEQ ID NO: 487 - protein, 389 aa, Marinobacter sp. Hb8
MFEQNPIFIPGPTNIPDRLRHAMNVQSSDHRSPDFVETLAPLLQDCKKVFGTQSGEVVLFPSSGTGGWEAAICNTLSPGDKVLIARYGMFSHRWIDMCQRHGLDVQIIECSWGSGAPADEFQRALSADTQHEIKAVLVTHNETATGVKSDIGAVREAMDSSAHPALLLVDCVSSLASMPFEMDDWGVDIAVSGSQKGFMLVTGMAILGVSQKALAAMENAELSRTFFDFRGMMAANAQGGFPYTPPLQLIYGLRESLKMLFEEGLDNVYARHFRLAEGVRQAVKAWGLDLCAQSPELHSHTVSAIYVPKGFDSNKLTDHAFSKYGVSFGIGLGEMYGKAFRIGHLGSLTDTMVLSGLATIEMAMADLDYPIELGEGVRAAQSYFRKTAA

SEQ ID NO: 488 - protein, 396 aa, Ruegeria sp. ZGT108
MSNQNPVFIPGPTNIPDRLRLAMQVQTQDHRAPDFVNTLAPVLEGTKKVFGSASGQIITFPASGTGGWEAAVTNTLSPGDTVLVARYGMFSHRWIDLCQRHGLDVRIIECAWGSGAPADQFAKALAADTAHQIRAVLVTHNETATGVRSDISAVRKAMDASDHPAMLFVDCVSSLASMPFAFDDWGVDIAVSGSQKGFMLATGMAILCVSPKALAAIETAKLPRTFFDFKDMMNANASGGFPYTPPLQLIYGMRESLNMLFEEGLDNVYARHTRLAEGVRKATAAWGLDLVAQSPELYSDTVSAIYVPEGFDSNALTDHAFNAYGVSFGVGLGEMNGKAFRIGHLGSLTDVMVLSGLATIEMAMADLNYPIDLGSGVSAAQEYFRSGRTTPMKTAA

SEQ ID NO: 489 - protein, 395 aa, Paracoccus sediminis DSM 26170
MTSQNPVFIPGPTNIPEVLRKAVDMPTIDHRSPVFGRILHPALEGVKKVLKTTDGQVFVFPSTGTGGWETAITNTLSPGDKVLATRNGMFSHRWIDMCQRHGLDVQVVAQEWGEGVPADRFEEILTADKGHEIKVVLATHNETATGVRSDIAAVRRALDAAGHPALLFVDGVSSIACYDFRMDEWGVDVAVTGSQKGFMLPPGLAIVGFSPKAMAAVETAKLPRTFFDIRDQARGYAANGFPYTPPVGLLNGLNVACQMLLDEGLENVFARHHRIAEGVRRAVAAWGMPLCAKRPDLYSDSVSAIRVPEGFDANKIVSHALNAYGVAFGTGLGDVAGKVFRIGHLGSLTDVMALSGIATAEMVMADLGLPVTLGSGVAAAQDHYRHSVPAMQKAA

SEQ ID NO: 490 - protein, 396 aa, Ruegeria scottomollicae DSM 25328
MSFQNPVFIPGPTNIPESLRKACDMPTIDHRSPLFGQILHPAREGVRKVLKSTSAEVFIFPSSGTGGWETALSNTLSAGDTVLAARNGMFSHRWIDMCQRHGLDVQIVETPWGEGLPADRYEEILSADKGHKIKAVLATHNETATGVKSDIAAVRRALDAAGHPALLFVDGVSSIASMDFRMDEWGVDVAVTGSQKGFMLSAGLAIVGFSPKAMEATKTAQLPRTFFDVHDMAKGYANNAYPYTPAVGLMNGLNESCKMLLTEGLENVFARHHRIAEGVRAAVGAWGLELCAASPEVYSDTVSAIRTPEGFNATDIVTHAADKYGVAFGVGLGEVAGKVFRIGHLGSLTDVMALSGIATAEMCMVDLGLDIQLGSGVAAAQDYYRGNAASAQQDAA

SEQ ID NO: 491 - protein, 396 aa, Rhizobium leguminosarum CGMCC 1.2553T
MYTQNPVFIPGPTNMPEVLRRATDLPTIDHRSAAFADILQPALAGVRKVVKSENAEIVVFPATGSGGWEATITNLLSPGDKVLAARSGMFSHRWIDMCQRHGLQVDAVHSSWKQPLPLAEYEKRLVADKGHEIKAVLVTHNETATGVKSDVGAVRRLLDDARHPALLLVDGVSSIASMDFRMDEWKIDAAITGSQKGFMLPVGLAILALSPKAMQATQSAKLHRAFFDIREMAKAYPSSGYPYTPSVGLLNGLKVSTELLLEEGLDNVFKRHARIASGVRAAISAWGLHLYAQEASSYSDTVSAVETPEGFDATSIVTHAAQKYAVAFGAGLGDVAGRVFRIGHLGSMSDVMALSGIATAEMAMADLGLPIRLGSGVAAAQEVYRNTEASPVRNAA

SEQ ID NO: 492 - protein, 300 aa, Sulfitobacter sp. HI0021
MCQRHGLAVQTVETAWGAGIPADRYEEILTADKSHEIKAVLATHNETATGVKSDIAAVRRALDASGHPAMLLVDGVSSIASMDFRFDEWGVDVAVTGSQKGFMLPAGLAIVGFSPKAMEATKTASLPRTFFDVHDMAKGYANNAYPYTPAVGLLNGLNQACNMLLTEGLENVFARHFRIAEGVRAAVGAWGLELCATDPSVYSDTVSAIRTPEDFNATDIVTHAANKYGVAFGVGLGEVAGKVFRIGHLGSLTDVMALSGIATAEMCMVDLGLDIKLGSGVAAAQEYYRGHTAAAQKDAA

SEQ ID NO: 493 - protein, 300 aa, Sulfitobacter sp. HI0076; identical to SEQ ID NO: 492

SEQ ID NO: 494 - protein, 396 aa, Thalassobius mediterraneus CECT 5118; identical to SEQ ID NO: 333

SEQ ID NO: 495 - protein, 396 aa, uncultured Rhodobacteriaceae sp. PT6CLA
MSDQNPLFIPGPTNMPDRLRHAMQVQTRDHRAPDFVETLMPVLDGCKTVFGTAEGSVITFPASGTGGWEAAITNTLSPGDTVLIARYGMFSHRWIDMCERHGLDVRIIECDWGSGAPADKFEEALKADSIHAIKAVLVTHNETATGVKSDIAAVRAAMDSASHPALLLVDCVSSLASMPFEMDAWGVDIAVAGSQKGFMLATGMAILAVSQKALAAMDGATLPRTFFDFRDMLQANSTGGFPYTPPLQLIHGMRESLSMLFEEGLDNVYARHHRLAEGVRQATRAWGLDLVAQSPELYSDTVSAIYVPDGFDSNVLTDHAFNAYGVSFGVGLGQMNGKAFRIGHLGALTDVMVLSGLATIEMAMADLNYPIELGVGVSAAQEYFRQSWDTALKSAA

SEQ ID NO: 496 - protein, 396 aa, Sinorhizobium terangae WSM1721
MSGYNHLFIPGPTNIPEQVRQAMNLPMEDMRSPQYPELTLPLFADVKKVFKNRNGRVFIYPSSGTGAWEAAMTNVLSPGDRVLMSRFGQFSHLWVDMAERLGFEVDCLDMEWGTGVPVELYAERLAADKAHRIKAVFVTHNETATGVTSDVAAARAALDACGHPALLFVDGVSSIGSIDFRQDEWGVDCAVSGSQKGFMLPAGLGFLSVSEKALEAAKTARHMRCYFSFDDMIKTNDTGYFPYTPPTQLLRGLRAALDLMFAEGLENIFARHHHLANGVRAAVSAWGLKLCATEPKWHSDTVSAIRLPEGVDGVEVIRHAYRTYNTSLGSGLSKIAGKVFRIGHLGSLNEVMVLGALGAAELTLLDCGVKIEPGSGVGAAVKQFRSVTRTSTAKAA

SEQ ID NO: 497 - protein, 396 aa, Sinorhizobium terangae WSM1721
MYLQNPVFIPGPTNMPEVLRKASDMPTIDHRSPLFGEILRPALAGVKKVVKSQSASIFVFPATGTGGWETAITNTLSPGDRVLVARYGMFSHRWIDMCQRHGLDVGVIETPWGSGAPVDRYEEMLTADKAHQIKAVLVTHNETATGVKSDIAALRRALDAARHPAMLFVDGVSSIASMEFRMDDWGVDVAVTGSQKGFMLPAGLAITAFSPKALAALETAKLPRTFFDVRDMSKSYENNAYPYTPAVGLLNGLKVSTEMLLAEGLENVFARHNRIATGIRAAVRAWGLELCAMSEDLYSDTVSAIRTPDGFDATSVVTHAAKKYDVAFGVGLGEVAGKVFRIGHLGSLTDVMALSGVATAEMVMADLGLAIKLGSGVAAAQDYYRNNQVSAGRGAA

SEQ ID NO: 498 - protein, 396 aa, Ruegeria sp. TW15; identical to SEQ ID NO: 416

SEQ ID NO: 499 - protein, 396 aa, Rhizobium sp. BR816
MPGYNHLFIPGPTNIPEQVRQAMNLPMEDMRSPRYPELTLPLFADVKKVFKNQDGRVFIYPSSGTGAWEAAMTNVLSPGDRLLMSRFGQFSHLWVDMAERLGFEVDCLDREWGTGVPVELYAERLAADKAHEIKAVFVTHNETATGVTSDVAAVRAALDACGHPALLFVDGVSSIGSIDFRQDEWGVDCAVSGSQKGFMLPAGLGFLSVSQKALEAAKTARHMRCYFSFDDMIKTNDTGYFPYTPPTQLLRGLRAALDLIFEEGLENIFARHHHLANGVRAGVSAWGLKLCATEPKWHSDTVSAIRLPEGIDGAEVIRHAYRTYNTSLGSGLSKVAGKVFRIGHLGSLNEVMVLGALSAAELTLLDCGVAIEPGSGVGAAIKQFRSAAATATAKAA

SEQ ID NO: 500 - protein, 396 aa, Rhizobium sp. BR816
MYLQNPVFIPGPTNLPEVLRKASDMPTIDHRSPLFGEILRPALAGVKKVVKSEAASIFVFPATGTGGWETAITNTLSPGDRVLVARYGMFSHRWIDMCKRHGLDVSVIETPWGSGAPVDRYEEMLTADKAHQIKAVLVTHNETATGVKSDIAAVRHALDSARHPAMLFVDGVSSIASMEFRMDDWGVDVAVTGSQKGFMLPAGLAITAFSPKALAALETAKLPRTFFDVRDMSKSYENNAYPYTPAVGLLNGLKVSTEMLLAEGLENVFARHNRIAAGIRAAVRAWGLELCASSEDLYSDTVSAIRTPDGFDATSVVTHAAKKYDVAFGVGLGEVAGKVFRIGHLGSLTDVMALSGIATAEMVMADLGLGIKLGSGVAAAQEYYRKNQVSGDRGAA

SEQ ID NO: 501 - protein, 389 aa, Glaciecola sp. ANT9081 (cola82)
MSDQNPVFIPGPTNIPSRLLNAMHVQTRDHRSPDFVATLAPVISDLKRVFGTDSGNVITFPSTGTGGWEAAICNTLSPGDKVLIARYGMFSHRWIDLCQRHGLNVEIIECSWGSGAPADQFETRLKADSAAEIKAVLVTHNETATGVLSDIKAVREAMNNANHPAMLYVDCVSSLGCMPFEMDAWGVDVAISGSQKGFMLPTGMAILAVSPKALAAMETAKLPRTFFDFCDMMAANTNGGFPYTPPLQLIYGLKESLAMIFEEGLENVYARHFRLAEGVRKAVAAWGLTLCANSPDLYSQTVTAIYVPEGFDSNQLTDHAFRTYGVSFGIGLGEMNTKAFRIGHLGSLTDVMVLSGLATIEMSMADLKYPIKLGAGVVAAQEYFRKTAN

SEQ ID NO: 502 - protein, 396 aa, Paracoccus pantotrophus J40; identical to SEQ ID NO: 344

SEQ ID NO: 503 - protein, 396 aa, Marinovum algicola DG 898; identical to SEQ ID NO: 468

SEQ ID NO: 504 - protein, 396 aa, Labrenzia alexandrii DFL-11
MSFQNPVFIPGPTNMPDALRKACDMPTLDHRSPLFGEILQPALSGVKKILKSELAEVFIFPSTGTGGWETVITNTLSPGDKILAARNGMFSHRWIDLCQRHGLDVVIVDTPWGTGLPADRYEEILAADTHHEIKAVLATHNETATGVKSDIAAVRRALNNAKHPALLYVDGVSSIASMDFRMDEWGVDAAVTGSQKGFMLPAGLAIVGLSPKAQAAVDQGKLPRTFFDIRDMRKSYAVNAYPYTPAVGLLNGLKHSCDMLLSEGLDNVFARHHRIAEGVRAAVHAWGLQLCAGSRDVYSDTVSAIRTPEGFNATDIITHAAGKYGVAFGVGLGEVAGKVFRIGHLGSLTDVMTLSGLATAEMVMADLGLSIKLGSGVAAAQDYYRTEEAVSSKEAA

SEQ ID NO: 505 - protein, 395 aa, Methylobacterium sp. 285MFTsu5.1
MSGQNPTFIPGPTNIPEVLRKAVDMPTIDHRSPIFGDILRPALEGVRRVLKTTQAEVFVFPSTGTGGWEAAITNVLSPGDRVLATRNGMFSHRWIDMCHRHGLDVQVVEQSWGEGIPADRYEEILTADRGHTIKVVLATHNETATGVRSDIAAVRRALDAAKHPALLFVDGVSSIGCMDFRMDDWHVDVAVAGSQKGFMLPAGLAIVACSQRAAQAAEHAQLPRTFFDIRDMRGSYGNGRFPYTPPVGLLNGLKVASDLLLAEGLETVFARHHRIAEGVRRAVAAWGLTVCAARPELYSDTVTAILLPNGVDSDRFVGHAQDAYGVAFGTGLGQLAGKVFRIGHLGSLTDVMALSGIAAAEMVLADLGAAVELGAGVAAAQEYYRKGSAMAQLAA

SEQ ID NO: 506 - protein, 396 aa, Methylobacterium sp. 285MFTsu5.1; identical to SEQ ID NO: 465

SEQ ID NO: 507 - protein, 396 aa, Methylobacterium sp. EUR3 AL-11; identical to SEQ ID NO: 337

SEQ ID NO: 508 - protein, 396 aa, Paracoccus yeei ATCC BAA-599
MTSQNPIFIPGPTNIPEEMRKAVDMPTIDHRSPVFGRMLHPALEGVKKVLKTTQAQVFLFPSTGTGGWETAITNTLSPGDKVLAARNGMFSHRWIDMCQRHGLDVQFVETPWGEGIPADRFEEILTADKAHDIKVVLATHNETATGVKSDIAAVRRALDAAGHPALLFVDGVSSIGSMDFRMDEWGVDIAVTGSQKGFMLPPGLAIVGFSPKAMEAVETAKLPRTFFDIRDMATGYARNGYPYTPPVGLINGLNVACERLLNEGLENVFARHHRIAGGVRAAVDAWGMKLCAVRPALYSDSVSAIRVPEGFDANLIVSHALETYDMAFGTGLGEVAGKVFRIGHLGSLTDAMALSGIATAEMVMADLGLPIKLGSGVAAAQEHYRQSTATAQKKAA

SEQ ID NO: 509 - protein, 396 aa, Defluviimonas sp. 20V17
MSFQNPVFIPGPTNIPESLRKACDMPTIDHRSPLFGQILHPAREGVRKVLKSESAEVFIFPSTGTGGWETALSNTLSAGDKVLAARHGMFSDRWIDMCRRHGLDVQVVETPWGEGLPADRFEEILTKDKGHEIKAVLATHNETATGVKSDIAAVRRALDQAGHPAMLFVDGVSSIASIDFRFDAWKVDVAVAGSQKGFMLPAGLAIVGFSEKAMDATRTSTLPRTFFDVNDMAKGYKNNGYPSTPAVGLLNGLNQACGMLLQEGLENVFARHHRIAQGVRAAVGAWGLELCAVDPSVYSDTVSAVRTPAGFNATDIVTHAAHKYGVAFGVGLGEVAGKVFRIGHLGSLTDVMALSGIATAEMCMADLGLKIELGSGVAAAQDYYRGHAAVARKDAA

SEQ ID NO: 510 - protein, 396 aa, Sphingomonas sp. DC-6
MSTQNPVFIPGPTNIPEVLRKAVDMPTIDHRSPLFGKILHPALEGVKKVLKTREAQVFVFPATGTGGWETAITNVLSAGDKVLATRNGMFSHRWIDMCQRHGLDVQVVMQEWGEGVPSDRFEEILAADKEHQIKVVLATHNETATGVRSDIAAVRHALDRTKHPALLFVDGVSSIGCYDFRMDDWGVDVAVTGSQKGFMLPPGLAIVGFSPKALQAVETATLPRTFFDIRDMAKGYAANGFPYTPPVGLLNGLKVATDMLLEEGLDNVFARHHRIAEGVRQAVAAWGLKLCAARPELYSDSVSAIRVPEGFDANKIVSHALNTYGVAFGTGLGDVAGKVFRIGHLGSLTDVMALSGIATAEMVMVDLGLPVTLGSGVAAAQDYYRQSANAAQKKAA

SEQ ID NO: 511 - protein, 396 aa, AP Rhodobacteraceae bacterium bin18
MSFQNPVFIPGPTNMPEALRRACDMPTLDHRSAAFADILQPAREGVRRILRSATAEVFIFPATGTGGWEVAITNTLSRGDTVLAARNGMFSHRWIDMCQRHGLTVEIVETPWGEGIPADRFEEILRADTDGRIKAVLATHNETATGVLSDIAAVRAAMDAAGHDALLFVDGVSSIASMPFEFDTWGVDVAVTGSQKGFMLPAGLAITGFSSRALAAVETGGLPRCFYDIRDMAKSYAANGYPYTPAVGLLNGLAQSCEMILTEGLDAVFARHARIAGGVRAAVTAWGLDLCAARPELYSNSVSAIRTPEGFDATRIVTHAADTYGVAFGVGLGEVAGKVFRIGHLGMLTDVLALSGIATAEMAMADLGLDIKLGSGVAAAQEVYRSTAAPMALAAE

SEQ ID NO: 512 - protein, 396 aa, Paracoccus sulfuroxidans CGMCC 1.5364
MTSQNPIFIPGPTNIPEALRKAVDMPTIDHRSPVFGRMLHPALEGVKKVLKTTKGEIFLFPSTGTGGWETAITNTLSAGDKVLAARNGMFSHRWIDMCQRHGLDVTFVETPWGEGIPADRFEEILTADKGHEIRVVLATHNETATGVRSDIAAVRRALDNAKHPAMLFVDGVSSIGSMDFRMDEWGVDVAITGSQKGFMLPPGLAITGFSPKAMEAVESARLPRTFFDIRDMATGYARNGYPYTPPVGLINGLNHAVTMLMDEGLENVFARHNRIASGVRAAVKAWGLELCARRPELYSDTVSAILVPEGFDANKIVSRALETYDMAFGTGLGQVAGKVFRIGHLGSLTDAMALSGLAVAEMVMADEGLPIQLGSGVAAAQDVYRNAAKAAQKKAA

SEQ ID NO: 513 - protein, 392 aa, Marinobacterium sp. AK27
MSDQNPVFIPGPTNIPDRLLNAMHMQTRDHRAPDFVETFAPVLEDCKHVFGTETGQVITFPASGTGGWEASITNTLSAGDTVLVARYGMFSHRWIDMCQRHGLEVQVIDCEWGSGAPADKFEQALRADKDKKIKVVLATHNETATGVKSDIAAVRRAMDAAGHPAMLFVDCVSSLASMPFEMDAWGVDIAVSGSQKGFMLSTGMAILGVSQKALAAMESATLPRTFFDFRDMMAANANGGFPYTPPLQLIYGMRESLKMLFEEGLENVYARHHRLAEGVRRAVEAWGLKLCAKSPELYSDTVSAIYVPEGFDSNKLTEHAFNTYGVSFGIGLGQMNGKAFRIGHLGMLTDVMCLSGLATIEMAMADLNYPVELGSGVRAAQEYYRATAAANQ

SEQ ID NO: 514 - protein, 396 aa, Yangia pacifica DSM 26894
MSFQNPVFIPGPTNIPESLRKACDMPTIDHRSPLFGQILHPAREGVRHVLKSASAEVFIFPSTGTGGWETALTNTLSPGDTVLAARNGMFSHRWIDMCQRHGLTVEVVETPWGEGLPAQRYAEILAADKSRRIKAVLATHNETATGVRSDIAAVRRALDEADHPALLFVDGVSSIASMDFRFDDWGVDCAVTGSQKGFMLPPGLAIVGFSEKAMAATKTAKLPRTFFDVTDMAKGYANNAYPYTPAVGLLNGLNESCRMLLDEGLENVFARHHRIAEGVRAAVRAWGLELCAASPEVYSDTVSAIRTPEGFNATDIVSHAAQTYGVAFGTGLGEVAGKVFRIGHLGSLTDVMTLSGLACAEMCMKDLGLDIALGSGVAAAQDFYRANPALARKEAA

SEQ ID NO: 515 - protein, 396 aa, Shimia haliotis DSM 28453
MSFQNPVFIPGPTNIPESLRKACDMPTIDHRSPLFGQILHPARKGVREILKSVDAEVFIFPSTGTGGWETALTNCLSAGDKILAARNGMFSHRWIDMCERHGLDVQIVETPWGEGLPADRYEEILTADTQHQIKAVLATHNETATGVKSDIAAVRRALDAAGHPAMLFVDGVSSIASMDFRMDEWGVDVAVTGSQKGFMLTAGLAIVGFSPKAIAATKSATLPRTFFDINDMTAGYANNAYPYTPAVGLLNGLNEACTMLLNEGLENVFARHHRIAEGVRAAVGAWGLDLCAADPSVYSDTVSAIRTPDGFNATDIVTHAASKYGVAFGVGLGEVAGKVFRIGHLGSLTDVMALAGIATAEMCMADLGLDIKLGSGVAAAQDYYRGHSAVSQKDAA

SEQ ID NO: 516 - protein, 394 aa, Hasllibacter halocynthiae DSM 29318
MSFQNPVFIPGPTNMPEDLRRACDMPTLDHRSPLFGEILHPALEGVAKVVGTKKGEVFVFPATGTAGWEVALTNTLSPGDKVLATRNGMFSHRWIDMCERHGLDVTVIRREWGEGIDAAAVEEALRADPAIKAVLATHNETATGVVSDIAAVRRAMDAAGSDALLFVDGVSSIASMPFHFDDWGVDVAITGSQKGFMLPPGLAITVFSAKAADAVEGAGLPRTFLDIRDMRKGYAAGGFPYTPPVGLLNGLNLSCRRLLDEGMKGVWARHHHIAEGVRAAVEAWGLELCAVSPELYSDTVSAIRTPEGFDANRLVAHAATRYGVAFGTGLGEVAGKVFRIGHLGSLTEPMALAGIATAEMAMRDLGLEVESGSGTAAAEEVYRGAGAPMAMAAE

SEQ ID NO: 517 - protein, 397 aa, Oceanicola nitratireducens DSM 29619; identical to SEQ ID NO: 403

SEQ ID NO: 518 - protein, 396 aa, Ruegeria halocynthiae DSM 27839
MSNQNPVFIPGPTNIPDRLRLAMQVQTQDHRAPDFVETFAPVLEDTKKIFGAAEGQIVTFPASGTGGWEAAVTNTLSPGDKVLVARYGVFSHRWIDLCERHGLDVQVVECPWGTGAPADRFEAILSADNAHEIKAVLVTHNETATGVRSDISAVRHAMNAATHPAMMFVDCVSSLASMPFEFDQWGVDIAVSGSQKGFMLATGMAILCVSPKALAAMKTANLPRTFFDFRDMMAANASGGFPYTPPLQLIYGMRESLKMLFEEGLENVYARHTRLAEGVRRAVDAWGLKLVAQSPDLYSETVSAIIVPEGFDSNELTDHAFNTYGVSFGIGLGELNGKAFRIGHLGSLTDVMALSGLATIEMAMADLNYPVELGSGVAAAQEFYRAGSSSHAQAAA

SEQ ID NO: 519 - protein, 396 aa, Citreimonas salinaria DSM 26880
MSLQNPVFIPGPTNIPDAIRKACDMPTMDHRSAAFADILHPALNGARQVMGQSTGETFVFPSTGTGGWETAIANTLSPGDRVLAARNGMFSHKWIDMCQRFGLQVTQIDVEWGEGVPTAAFEEALRADTGGGIKAVLATHNETATGVVSDIAGVRRALDAAGHGALLLVDGVSSIGSMPFDFDGWGVDVAVTGSQKGFMLPVGLAIVGFSDKAVAASQTATLPRTFFSIDDMRKGYAANGYPYTPAVGLLNGLKLSTAMLLDEGLENVFARHARIASGVRAAVAAWGLELCAKSPELYSNTVTAVRTPEGFDASRIVETASRDYGMAFGTGLGDVAGKVFRIGHLGSMTDAMALSGIATAEMVMADLGLDITLGAGVAAAQSVYRHGAQTERMAAQ

SEQ ID NO: 520 - protein, 396 aa, Ruegeria mobilis S1942
MSFQNPVFIPGPTNIPESLRKACDMPTIDHRSPLFGQILHPARDGVRKVLKSTSAEVFIFPSSGTGGWETALSNTLSAGDTVLAARNGMFSHRWIDMCQRHGLDVQIVETPWGAGLPADRYEEILSADKAHKIKAVLATHNETATGVKSDIAAVRRALDAAGHPALLFVDGVSSIASMDFRMDEWGVDVAVTGSQKGFMLSAGLAIVGFSPKAMEATKTAQLPRTFFDVHDMAKGYANNAYPYTPAVGLMNGLNESCKMLLAEGLENVFARHHRIAEGVRAAVGAWGLELCAASPEVYSDTVSAIRTPEGFNATDIVTHAADKYGVAFGVGLGEVAGKVFRIGHLGSLTDVMALSGIATAEMCMVDLGLDIRLGSGVAAAQEYYRGNAASAQQDAA

SEQ ID NO: 521 - protein, 396 aa, Leisingera aquaemixtae CECT 8399
MSFQNPVFIPGPTNMPEALRKAVDMPTLDHRSPLFGQILHPALAGVKKVLKSETAEIFVFPSTGTGGWETAITNTLNAGDKILAARNGMFSHRWIDMCQRHGLDVQIVETPWGEGLPADRYEEILTADTAHEIKVVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVRAWGLELCAVSPEVYSDSVSAIRTPDGFDANTFVSLAAEKYGVAFGTGLGEVAGKVFRIGHLGSLTDVMTLSGIATAEMVMADLGLNIKLGSGVAAAQDYYRVNSASSAKAAA

SEQ ID NO: 522 - protein, 396 aa, Leisingera aquaemixtae CECT 8399
MSFQNPVFIPGPTNMPEALRKAVDMPTLDHRSPLFGQILHPALAGVKKVLKSETAEIFVFPSTGTGGWETAITNTLNAGDKILAARNGMFSHRWIDMCQRHGLDVQIVETPWGEGLPADRYEEILTADTAHEIKVVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVRAWGLELCAVSPEVYSDSVSAIRTPDGFDANTFVSLAAEKYGVAFGTGLGEVAGKVFRIGHLGSLTDVMTLSGIATAEMVMADLGLNIKLGSGVAAAQDYYRGNSASSAKAAA

SEQ ID NO: 523 - protein, 396 aa, Paracoccus halophilus JCM 14014; identical to SEQ ID NO: 397

SEQ ID NO: 524 - protein, 396 aa, Ruegeria sp. ZGT118
MSFQNPVFIPGPTNIPESLRKACDMPTIDHRSPLFGQILHPAREGVRKVLKSDSAEIFIFPSTGTGGWETALTNTLSAGDTVLAARNGMFSHRWIDMCQRHGLKVDIVETAWGEGLPADRYAEILAADTAHEIRAVLATHNETATGVKSDIAAVRRALDAAGHPAMLFVDGVSSIASMDFRFDEWGVDVAVTGSQKGFMLPAGLAIVGFSRKAMDATRTGTLPRTFFDVHDMAKGYASNAYPYTPAVGLLNGLNQACDLLLREGLENVFARHHRIAEGVRAAVRAWGLDLCAVDPSVYSDTVSAIRTPEGFNATDIVTHAAEKYGVAFGVGLGEVAGKVFRIGHLGSLTDVMALSGIATAEMCMADLGLDIKLGSGVAAAQDYYRGHPAEAHKDAA

SEQ ID NO: 525 - protein, 396 aa, Ruegeria faecimaris DSM 28009
MSNQNPVFIPGPTNIPDRLRLAMQVQTQDHRAPDFVQTFAPVLEDTKKVFDTATAQIVTFPASGTGGWEAAITNTLSPGDKVLIARYGVFSHRWIDLCTRHGLDVQVIDCPWGSGAPADQFQTVLTGDKAHEIRAVLVTHNETATGVLSDIGAVRRAMDAANHPALLMVDCVSSLASVPFEFDRWGVDIAVSGSQKGFMLATGMAILCVSQKALDAMETAELHRTFFDFRDMMAANATGGFPYTPPLQLIYGLRESLKMLFEEGLPNVYARHHRLAEGVRRAVDAWGLELVAQSPDLYSDTVSAIYVPEGFDSNILTDHAFNTYGMSFGVGLGQLHGKAFRIGHLGSLTDAMVLSGLCTIEMAMADLSYPITLGSGVAAAQEHFRATPGNRTEAAA

SEQ ID NO: 526 - protein, 396 aa, Shimia sagamensis DSM 29734
MSFQNPVFIPGPTNIPESLRKACDMPTIDHRSPLFGQILHPAREGVRKVLKSESAEIFIFPSTGTGGWETALTNTLSAGDKILAARNGMFSHRWIDMCQRHNLDVQVVETPWGEGLPADRYEEILTADTNHEIKAVLATHNETATGVKSDIAAVRRALDAAGHPALLFVDGVSSIASMDFRMDEWGVDVAVTGSQKGFMLTAGLAIVGFSAKAMAATETAKLPRTFFDVHDMAKGYAANAYPYTPAVGLLNGLNEACTMLLNEGLENVFARHTRIAEGVRAAVGAWGLELCAANPSVYSDTVSAIKTPEGFNATDIVTHAAEKYGVAFGVGLGEVAGKVFRIGHLGSLTDVMALSGIATAEMCMVDLGLDIKLGSGVAAAQDYYRGNTATAQKDAA

SEQ ID NO: 527 - protein, 300 aa, Sulfitobacter sp. HI0027; identical to SEQ ID NO: 492

SEQ ID NO: 528 - protein, 391 aa, Psychrobacter cryohalolentis K5
MSLQNPIFIPGPTNIPDRLRRAMNVPTQDHRAPDFSDTFLPVLADCKKVFGTQDGEIILFTSSGTGGWEAAISNTLSPGDKVLIARYGMFSHRWIDMCQRHGLDVQVVECDWGTGAPADKFQAILNEDTAHEIKAVMVTHNETATGVLSDIGAVRKAMDSSDHPALLFVDGVSSIACVPFEMDAWGVDVAVAGSQKGFMLATGMAILGVSQKALSHMDEAKLPRTYFAFRDMLNANANGGFPYTPPLNLIYGLRESLEMLFDEGLDNVYARHYRLAEGVRQAVSAWGMKLCAKTPDLYSNTVSAIFVPEGFDSNKLTDHAFNKYGISFGIGLGEMNGKAFRIGHLGSLTEVMVLAGLATIEMAMVDLGYPIKLGQGVAAAQEYYRHSAPTK

SEQ ID NO: 529 - protein, 396 aa, Rhodobacterales bacterium Y4I scf_1106129324775 genomic scaffold; identical to SEQ ID NO: 309

SEQ ID NO: 530 - protein, 396 aa, cNanh_4411
MSFQNPVFIPGPTNMPEAVRQACYMPTIDHRSPVFGKILHPCLEGVQKVLKSDSARIFIFPSTGTGGWETALTNALSAGDGVLAARNGMFSHRWIDMCQRHGLDVTIVETPWGHGLPADRYEEILRADTGHRIKAVLATHNETATGVRSDIAAVRRALDAAGHPAMLFVDGVSSIGSMDFRFDEWGVDVAVTGSQKGFMLPAGLAIVGFSDKAMAAVETTTLPRTFFDIRDMAKGYAANAFPYTPPVGLMNGLKLSLDMLLSEGLENVFARHHRIAEGVRRAVGAWGLDLCAASPDLYSDSVSAIRTPEGFNATDIVTRAANEYGMAFGVGLGEVAGKVFRIGHLGSLTDAMMLSGLGVAEMVMVDLGLEVRLGSGVAAAQDYYRHGSGKTNKAAA

SEQ ID NO: 531 - protein, 396 aa, Methylobacterium mesophilicum SR1.6/6
MFAQNPVFIPGPTNMPEVLRRAADMPTLDHRSPLFAQILHPALAGVKTVLKSEDAEVFIFPSTATGGWETALSNTLSAGDTVLAARHGMFSHRWIDMTRRHGLDVRMIEAPWGEGVPADRFAEALAADTAHRIRAVLVTHNETATGVRSDVAAVRRALDASNHPALLLVDGVSSIASMDFRMDAWGVDVAVTGSQKGFMLPAGLAIVAFSPKAMAATATATLPRTYFDIRDMAKGYPNGAYPYTPAVGLLNGLKLSTELLLAEGLENVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMADLGLRIELGSGVAAAQAVYRRAPAAALRAAA

SEQ ID NO: 532 - protein, 396 aa, Methylobacterium sp. B34; identical to SEQ ID NO: 465

SEQ ID NO: 533 - protein, 400 aa, Roseivivax halodurans JCM 10272
MRTGQTHLFIPGPTNIPESVRQAMNVPMQDMRAPDFGALTLGLFDGLRRVMRSASAEVFLFPGSGTGAWEAAITNTLNPGDKVLMSRHGQFSTLWVEMAERLGLDVEVIDVPWGQGVPVAEFERRLGEDREDAIKAVFVTHNETATGVTSDVAGVRRALDETFHDALLFVDGVSSIASIDFRMDEWGVDLAVTGSQKGLMCPAGLGILAVSEKAMDASTRSTMRRAYFEFSDMRKMNADGYFPYTPPTQILHGLAKSLARIEAEGLDAVIARHHRLAEGVRRGVSAWGLDLVAAEPALYSDTVSAIRVPEAVDAREVIRIAYEEYNTSFGTGLAQLAGKVFRIGHLGDLNEGMCLSALGIAEMALARSGVRLQLGSGVAAAQAFYAFGTEARERIALAAE

SEQ ID NO: 534 - protein, 395 aa, Roseivivax halodurans JCM 10272
MHFQNPVFIPGPTNIPERLRRACDLPTIDHRSPRFGDILHPAREGVRRVMKSETAEIFLFPASGTGGWEAAITNTLSAGDRVLVSRYGMFSHRWIDLCQRHGLDVTIIDAPWGDALPVERCAEVLAADKSHEYKAVLATHNETATGVRSDIAGLRRAMDGAGHPALLMVDGVSSIASMDFRFDEWRVDVAVTGSQKGFMLPPGLAILGFSQKAMAASKEARLSRTYFDVHDMAKGYAQNAYPYTPTPGLLNGLAMACDMLLDEGLENVFARHHLIAEGVRAAVRAWGLELCATAPEISSDTVSAIRTPEGFDASRIVAHAAQTYDVAFGAGLGEVAGKVFRIGHLGSLTDVMALAGLATAEMCMVDLGLDIRLGSGVAAAQEFYRTEQGLRAVAA

SEQ ID NO: 535 - protein, 411 aa, Pelagicola litoralis DSM 18290
MLRASFVEKFKKGAVMSFQNPVFIPGPTNMPEGLRKAVDMPTLDHRSSLFADILHPALAGVKKVLKSETAEVFIFPSTGTGGWETALTNTLSAGDKVLAARNGMFSHRWIDMCTRHGLDMTVVDAPWGAGIPLDRYEDILRKDVNHEIKVVLATHNETATGVRSDIAGVRRAMDAAGHPALLYVDGVSSIGSMDFQMDAWGVDIAVTGSQKGFMLPAGLAIVAFSPKAVARTETAGLARTFFDVRDMAAGYANNAYPYTPAVGLLNGLKTSTEMLLEEGLEAVFARHTRIANGVRAAVDAWGLALCAASPDLYSDTVSAIVTPQGFNATDIVTHAADVYDVAFGVGLGDVAGKVFRIGHLGSMTDVMALAGIATAEMCMVDLGLDIQLGAGVAAAQESYRASTADARRAAA

SEQ ID NO: 536 - protein, 396 aa, Thalassobacter stenotrophicus DSM 16310
MISQNPVFIPGPTNMPEVLRKSCDMPTLDHRSAAFAGILHPALEGVKKVLKTTSAEVFVFPSTGTGGWETALTNTLSPGDTVLVGRNGMFSHRWIDMCERHGLDVIVLDTAWGQGLPVDRYGEVLAQDTEHRIKAVLATHNETATGVVSDIAGLRAAMDASDHPALLLVDGVSSIGSMNFEMDAWGVDIAVTGSQKGFMLPAGLAIVGVSQRALGAMATAKLPRTFFDLRDMQKGYAVNGYPYTPPVGLLNGLKLACDMLLEEGLENVFARHRRIADGVRAAVAAWGLELCAERPEWQSDTVSAVRTPEGFDAGEIVTHAAEVYDMAFGVGMGEVAGKVFRIGHLGMLTEAQALCGLATVEMCMVDLGLDIQLGSGVAAAQGVYRHGTRQQAMAAE

SEQ ID NO: 537 - protein, 396 aa, Methylobacterium sp. UNC300MFChir4.1
MFAQNPVFIPGPTNMPEVLRRAADMPTLDHRSPLFAQILHPALAGVKKVLKSEDAEVFIFPSTATGGWETALSNTLSAGDTVLAARHGMFSHRWIDMTRRHGLDVRVIEAPWGEGLPADRFAEALAADKAHRIRAVLVTHNETATGVRSDVAAVRRALDASNHPALLLVDGVSSIASMDFRMDAWGVDVAVTGSQKGFMLPAGLAIVAFSPKALAATATATLPRTYFDIRDMAKGYPNGAYPYTPAVGLLNGLKLSTELLLAEGLETVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMADLGLRIALGSGVAAAQAVYRRAPAAALRAAA

SEQ ID NO: 538 - protein, 396 aa, Paracoccus pantotrophus DSM 1403; identical to SEQ ID NO: 469

SEQ ID NO: 539 - protein, 396 aa, Rhizobium lusitanum P1-7; identical to SEQ ID NO: 394

SEQ ID NO: 540 - protein, 395 aa, Paracoccus alkenifer DSM 11593
MSTQNPIFIPGPTNIPELLRKAVDMPTIDHRSPLFGKILHPALAGVKQVLKSTRAEVFVFPATGTGGWETAITNTLSPGDKVLATRNGMFSHRWIDMCRRHGLDVQVVMQDWGEDVPAARFEEILTADTAHEIKVVLATHNETATGVRSDIAAVRRAMDAAGHPALLFVDGVSSIGCYDFRMDEWGVDVAVTGSQKGFMLPPGLAIVGFSPRAMAAVEMAALPRTFFDIRDMAKGYAVNGYPYTPPVGLLNGLKLATEMLLGEGLDNVFARHHRIAEGVRRAVAAWGMKPCAARPELYSDSVTAIRTPEGFDANRIVSRALDSYGVAFGTGLGDVAGKVFRIGHLGSLTDVMALSGIATAEMVMADLGLPVVLGSGVAAAQDHYRRTAPAAPATA

SEQ ID NO: 541 - protein, 396 aa, Loktanella koreensis DSM 17925
MSFQNPVFIPGPTNMPEDIRKACDMPTIDHRSPLFGQILHPARAGVQKVLKSDYAEIFIFPSTGTGGWETAITNTLSHGDKVLIARNGMFSHKWIDMCQRHKLEVEIVEVPWGQGIPADRYGDILAADTNHEIRAVLATHNETATGVKSDIAAIRAVMDACDHPALLLVDGVSSIGSMDFRFDEWKVDVAVTGSQKGFMLPAGLAIVGFSPKAMGATKTARLPRTFFDVHDMAKGYDNNAYPYTPAVGLMNGLKLACDKLLAEGLDNVFARHHRIASGVRAAVDAWGLDLCAVDASVYSDSVSAIVTPGGFNASDIVTLAAEKYGVAFGTGLGEVAGKVFRIGHLGSLTDVMALSGIATAEMCMVDLGLDITLGSGVAAAQEYYRGNAVKSLREAA

SEQ ID NO: 542 - protein, 395 aa, Methylobacterium sp. 190MF; identical to SEQ ID NO: 505

SEQ ID NO: 543 - protein, 396 aa, Methylobacterium sp. 190MF; identical to SEQ ID NO: 465

SEQ ID NO: 544 - protein, 396 aa, Ruegeria sp. ANG-S4
MSNQNPVFIPGPTNIPDRLRAAMQVQTQDHRAPDFVETFAPVLEDTKSVFGTQQGQVITFPSSGTGGWEAAITNTLSPGDKVLVARYGVFSHRWIDLCARHGLDVQVIECAWGDGAPAATFQSILADDVGREIRAVLVTHNETATGVYSDIAAVRQAIDAAGHPAMLFVDCVSSLASMPFEFDNWGVDVAVSGSQKGFMLAAGMAILCVSPKALAAMDAATLPRTYFDLADMMAANASGGFPYTPPLQLIYGMRESLRMLFEEGLDNVYARHFRLAEGVRRAVDAWGLKLVATSPKLYSDTVSAIYVPDGFDSNALTDHAFNTYGVSFGIGLGQLNGKAFRIGHLGSLTDVMVLSGLATIEMAMADLNYPIELGSGVAAAQDYFRSGSQGRAQAAA

SEQ ID NO: 545 - protein, 396 aa, Leisingera nanhaiensis CGMCC 1.10959; identical to SEQ ID NO: 530

SEQ ID NO: 546 - protein, 396 aa, Loktanella rosea DSM 29591
MSFQNPVFIPGPTNMPEAIRKACDMPTIDHRSPLFGQILHPARAGVQKILKSDTAEVFIFPSTGTGGWETALTNTLSPGDTVLAARNGMFSHRWIDMCQRHGLDMQIVETPWGQGIPADRYAEILKADTAHKIKVVLATHNETATGVKSDIAAVRKALDAAGHPAMLFVDGVSSIGSMDFRFDEWGVDVAVTGSQKGFMLPAGLAIVGFSQKALAASKTAKLPRTFFDIADMTKGYAANAYPYTPAVGLMNGLLLATEMLLKEGLENVFTRHNRIASGVRAAVDAWGLELCAETPDLYSDTVSAVKTPDGFNATDIVTLAAEKYGVAFGVGLGEVAGKVFRIGHLGSMTDVMALSGIATAEMCMVDLGLDIQLGSGVAAAQEYYRGSTGLKMRDAA

SEQ ID NO: 547 - protein, 396 aa, Poseidonocella pacifica DSM 29316
MSGFKGLAVPGPTNMPFEIRRAMDVALEDHRAPDFPDFIKPLLADLKKVFQTETGQVFVFPGSGTGGWESAIANTLAPGDTVLASIFGQFSYLWVDMCRKFGLNVDAIECEWGTGVPADLYEQKLAADKEHKIKAVLVTQNETATGVTSDVKAVREALDRTGHPALLFVDGVSSIGSIDFRQDEWGVDVAVSGSQKGFMLPTGLAIVGVSRKALAHRPEGGLPRCFFDYQDMAKTNADGFFPYTPATTLLRGLRASLDMIFDEGLENIFARHHRLAEGVRRAVDAWGMSLCAKEAKWNSDTVSAIVVPEGYNANDVIQTAYHKYDLSLGAGLSKVAGKVFRIGHLGYLNEIMVLQALGGAELAMRDVGLPFTPGVGVGAAVEYYAATGQAEALAAQ

SEQ ID NO: 548 - protein, 396 aa, Poseidonocella pacifica DSM 29316
MSDQNPVFIPGPTNIPDRLRMAMSMQTKDHRAPDFVETFAPVLEDTKRVFGTAEGEIILFPGSGTGGWEAAITNTLSPGDAVLIARYGMFSHKWIDMCERHGLDVRVVECPWGEGAPAERFGEILADDTAGEIKAVLVTHNETATGVMSDISLVRKAMDGANHDALLLVDCVSSLACVPFEMDAWGVDIAVSGSQKGFMLQTGMAILGVSQKALNTMEGAKLPRTYFDFRDMRKAYVGGGYPYTPPVQLIQGLRTSLDMLFEEGLGAVYDRHVRLAEGVRRAASAWGLSLCAARPELYSQTVSAIYVPSGFDSNALTEHAYRAYGVSFGVGLGEMNGKAFRIGHLGMLTDVMVLSGLATIEMAMADLGYPIELGSGVAAAQEHYRASRANALRSAA

SEQ ID NO: 549 - protein, 396 aa, Leisingera sp. ANG-S5
MSFQNPVFIPGPTNMPEALRKAVDMPTLDHRSPLFGQILHPALAGVKKVLKSETAEIFVFPSTGTGGWETAITNTLNSGDKILAARNGMFSHRWIDMCQRHGLDVQVVETPWGEGLPADRYEEILTADTSHQIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVRAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNTASSTKAAA

SEQ ID NO: 550 - protein, 396 aa, Cribrihabitans marinus DSM 29340
MSFQNPVFIPGPTNMPEALRKACDMPTIDHRSPLFGQILHPAREGVRKILKSDSAEIFIFPSTGTGGWETALTNTLSAGDKVLAARNGMFSHRWIDMCQRHGLKVEVVETPWGEGLPADRYEEILTADTGHEIKVVLATHNETATGVKSDIAAVRRALDAAGHPALLFVDGVSSIASMDFRFDEWGVDVAVTGSQKGFMLPAGLAIVGFSAKAMQATGTGTLPRTFFDVHDMAKGYANNAYPYTPAVGLLNGLNDACAMLLGEGLDNVFARHHRIAEGVRAAVRAWGLDLCARSPEVYSDTVSAIRTPEGFNATDIVTLAAEKYGVAYGTGLGEVAGKVFRIGHLGSLTDVMALSGIATAEMVMADLGLDIQLGSGVAAAQDVYRSPQPTHSRAAA

SEQ ID NO: 551 - protein, 396 aa, Ruegeria mobilis DSM 23403
MSFQNPVFIPGPTNIPESLRKACDMPTIDHRSPLFGQILHPARDGVRKVLKSETAEVFIFPSSGTGGWETALSNTLSAGDTVLAARNGMFSHRWIDMCQRHGLDVQIVETPWGAGLPADRYEEILSADKDHKIKAVLATHNETATGVKSDIAAVRRALDAAGHPALLFVDGVSSIASMDFRMDEWGVDVAVTGSQKGFMLSAGLAIVGFSPKAMEATKSAQLPRTFFDVHDMAKGYANNAYPYTPAVGLMNGLNESCKMLLAEGLENVFARHHRIAEGVRAAVGAWGLELCAATPEVYSDTVSAIRTPEGFNATDIVTHAADKYGIAFGVGLGEVAGKVFRIGHLGSLTDVMALSGIATAEMCMVDLGLDIRLGSGVAAAQEYYRGNAASAQQDAA

SEQ ID NO: 552 - protein, 396 aa, Pseudopelagicola gijangensis DSM 100564
MSFQNPVFIPGPTNMPEALRRAADMPTLDHRSSLFAEILHPALDGVKQVLKSKTAEVFVFPSTGTGGWETALTNTLSAGDKVLAARNGMFSHRWIDMCTRHGLDMQIVEAAWGAGVPTDRYEEILRADKNHEIKVVLATHNETATGVKSDIAGVRRALDNAGHPALLYVDGVSSIGSMDFRMDEWGVDIAVTGSQKGFMLPAGLAIIGFSPKAMAQVETATLPRTFFDIRDMAAGYANNAYPYTPAVGLLNGLKLATEMLLNEGLENVFTRHNRIANGVRAAVNAWGLTLCAQSPDLYSDSVSAIMTPEGFNATDIVSHAADVYGVAFGVGLGEVAGKVFRIGHLGSLTDVMALSGIATAEMCMVDIGLDIQLGSGVAAAQEVYRQTTGYTLKAAA

SEQ ID NO: 553 - protein, 396 aa, Ruegeria atlantica CECT 4293
MSNQNLVFIPGPTNIPDRLRLAMQVQTQDHRAPDFVETFAPVLEDTKKVFGTTTGQIVTFPSNGTGGWEAAVTNTLSPGDKVLVARYGVFSHRWIDLCERHGLDVQIVECPWGTGAPADQFQAALADDTAHEIRAVLVTHNETATGVRSDIAAVRQAMDSENHPAMLFVDCVSSLASMPFDFDAWGVDIAVSGSQKGFMLATGMAILCVSPKAQDAMKSAKLPRTFFDFDDMMAANASGGFPYTPPLQLIYGMRESLKMLFEEGLENVYARHFRLAEGVRRAVDAWGLKLVAQSRDLYSDTVSAIYVPDGYDSNTLTDHAFNAYGVSFGIGLGQLNGKAFRIGHLGSLTDVMVLSGLSTIEMAMADLNYPITLGSGVAAAQDYYRTGPSDRAQAAA

SEQ ID NO: 554 - protein, 396 aa, Thalassobacter stenotrophicus CECT 5294; identical to SEQ ID NO: 536

SEQ ID NO: 555 - protein, 396 aa, Loktanella sediminilitoris DSM 29955
MSFQNPVFIPGPTNIPENLRKACDMPTIDHRSPLFGTILHPARDGVRKVLKSDKAEVFIFPSTGTGGWETAVTNCLSSGDKVLAARNGMFSHRWIDLCQRHGLDVEIVEASWGAGIPVDRYEEILTADTSHQIKAVLATHNETATGVKSDIAAVRKALDAAGHPALLFVDGVSSIGSMDFRFDEWAIDVAVTGSQKGFMLPPGLAIVGFSEKAMAATKTGTLPRTFFDVHDMAKGYANNAYPYTPAVGLLNGLTEACGMLMAEGLENVFARHTRIAEGVRAAVDAWGLELCAETPDVYSDTVSAIRTPEGFNATDIVTHAAETYGVAFGVGLGDVAGKVFRIGHLGSLTDVMTLSGLATAEMCMVDLGLDIKLGAGVAAAQEYYRAHTAFAQKAAA

SEQ ID NO: 556 - protein, 396 aa, Rhizobium taibaishanense DSM 100021T
MYMQNPVFIPGPTNMPEVLRKASDMPTLDHRSPLFGEILRPALAGVKKVLKTETASVFVFPSTGTGGWETAITNTLSPGDRVLAARYGMFSHRWIDMCQRHGLKVDVIESVWGGGAPADRYEEILTADTGHEIKAVLVTHNETATGVKSDIGAIRQAIDAAKHPALLFVDGVSSIASMDFRMDGWAVDIAITGSQKGFMLPAGLAIAAFSAKALEALDSAKLPRTFFDVRDMTKSYANNAYPYTPAVGLLNGLKLSTELLLAEGLENVFARHRRIASGIRAAVRAWGLELCAKDEELYSDTVSAIRTPEGFDATSIVTHAARKYDVAFGVGLGEVAGKVFRIGHLGSLTDVMALSGIATAEMVMVDLGLEITLGSGVAAAQDHYRNVHLSAVQAAA

SEQ ID NO: 557 - protein, 396 aa, Rhodobacteraceae bacterium JGI 01_L11_4000m (contamination screened)
MSFQNPVFIPGPTNIPESLRKACDMPTIDHRSPLFGQILHPARAGVRQILKSDNAEVFIFPSTGTGGWETALTNTLSPGDKVLAARNGMFSHRWIDMCQRHGLSVQVVETTWGAGLPADRYEEILTADKNHEIKAVLATHNETATGVKSDIAAVRRALDASGHPAMLFIDGVSSIASMDFRFDEWGVDVAVTGSQKGFMLPAGLAIVGFSPKAMEATKTATLPRTFFDVHDMAKGYANNAYPYTPAVGLLNGLNQACDMLLREGLENVFARHHRIAEGVRAAVGAWGLDLCATDPSVYSDTVSAIRTPEGFNATDIVTHAANRYGVAFGVGLGEVAGKVFRIGHLGSLTDVMALSGIATAEMCMVDLGLNIELGSGVAAAQEYYRGHSAAAQKDAA

SEQ ID NO: 558 - protein, 396 aa, Sulfitobacter sp. HI0054; identical to SEQ ID NO: 557

SEQ ID NO: 559 - protein, 396 aa, Labrenzia aggregata CECT 4801
MSFQNPVFIPGPTNMPEALRRACDMPTLDHRSPLFGQILQPALAGVKKVLKTETAEVFLFPSTGTGGWETAITNCLSPGDKILAARNGMFSHRWIDMCQRHGLKVEVVEAAWGTGLPADRYEEILAADTNHEIKAVLATHNETATGVKSDIAAVRRALNAAKHPALLFVDGVSSIASMDFRMEEWGVDAAVTGSQKGFMLPPGLAIIALSPKAQAAVESARLPRTFFDVRDMMKAYANNAYPYTPAVGLMNGLKQSCDMLLAEGLDNVFARHHRIAEGVRAAVRAWGLELCAQTPDVYSDSVSAIRTPEGFNATGIVTHAAAKYGVAFGVGLGEVAGKVFRIGHLGSLTDVMMLSGLATAEMVMADLGLDIQLGSGVAAAQEVYRSDSAIASKEAA

SEQ ID NO: 560 - protein, 397 aa, Roseovarius nubinhibens ISM
MSLQNPTFIPGPTNLPEVLRKACDMPTIDHRSPLFGDILRPARAGVQQVLKSRDAEILIFPSTGTGGWETALTNTLAPGDTVLAARNGMFSQRWVDMCQRHGLTVEIVETPWGEGIPADRFEEILSADKAHKIKAVLATHNETATGVRSDISAVRRAMDAAAHPALLFVDGVSSIGSMDFRFDDWGVDIAVSGSQKGFMLPAGLAILGLSPKAMAAAETATLPRAFFDIRDMKRAYDNAAYPYTPLVGLLNGLNLSTKMLLDEGLDNVFARHRRIADGVRAAVAAWGLPLCAATPDLYSDTVSAVRTPEGVDATEIVRRAAADYGVAFGVGLGQLSGKAFRIGHLGSLTDVMMLSGLATLEMCMADLGLDIRPGSGVAAAQDVYRKSQTPQAREAAE

SEQ ID NO: 561 - protein, 396 aa, Roseobacter sp. SK209-2-6
MSFQNPVFIPGPTNMPEALRKAVDMPTLDHRSPLFGQILHPALAGVKKVLKSESAEIFVFPSTGTGGWETSITNTLNAGDKILAARNGMFSHRWIDMCQRHGLDVQVVETPWGEGLPADRYEEILTADKNHEIKAVLATHNETATGVKSDIAAVRRALDAAGHPALLFVDGVSSIASMDFRMDEWDVDIAVTGSQKGFMLPPGLAIVGFSPKAMKASGTATLPRTFFDIKDMANGYAANAYPYTPSVGLLNGLNMACGMLLDEGLENVFARHHRIAEGVRAAVRAWGLELCAASPEVYSNSVSAIRTPEGFDANRFVSLAAEKYGVAFGTGLGEVAGKVFRIGHLGSLTDVMALSGIATAEMVMADLGLDIPLGSGVAAAQDYYRGHEVSASKVAA

SEQ ID NO: 562 - protein, 388 aa, Rhodobacterales bacterium HTCC2083 scf_1106200183017 genomic scaffold
MSFQNPVFIPGPTNMPEEIRLACHMPTIDHRSPIFGGILHPCLDGVRRVLKSEKAHIYIFPSTGTGGWETTLTNTLSVGDKVLVARNGMFSHRWIDMCERHGLDVQIVEAAWGDGLPVAEYEAILKADTGHSIKAVLATHNETATGVKSDIAGVRKALDAAAHPALFFVDGVSSIGSMDFRMDDWGIDVAVTGSQKGFMLPAGLAIVGFSDKARAAVEIATLPRTFFDIRDMEKGYAANAFPYTPPVGLMNGLKHSLEMIEAEGLENVFARHTRIATGVRHAVDAWGLELCANAPELYSDSVSAIRTPEGFNATDIVTRADEQYGMAFGVGLGEVAGKVFRIGHLGMLTDAMMLSGLGVAEMVMKDLGFDIKLGSGVGAAQEFYRFGA

SEQ ID NO: 563 - protein, 396 aa, Agrobacterium sp. ATCC 31749 AGT22
MSTQNPIFIPGPTNIPEVLRKAVDMPTIDHRSPLFGNILHPALEGVKAILKTSKAEVFVFPSTGTGGWETAITNTLSAGDKVLATRNGMFSHRWIDMCQRHGLDVQVVMQEWGDGVPADTFEEILTADKGHEIKVVLATHNETATGVRSDIAAVRRALDNAKHPALLFVDGVSSIACYDFRMDEWGVDVAVTGSQKGFMLPPGLAILGFSQKALAATGSARLPRTFFDVRDMAKGYASNGYPYTPPVGLLNGLKVATDMLLDEGLENVFARHHRIAEGVRRAVSAWGLELCAARPELYSDSVSAIRTPEGFDANKIVAHALNTYGVAFGTGLGDVAGKVFRIGHLGSLTDVMALSGIATAEMVMADLGLPVTLGSGVAAAQQSYRQSAGNAQRKAT

SEQ ID NO: 564 - protein, 396 aa, Paracoccus sp. TRP Paracoccus_TRP_Contig_10; identical to SEQ ID NO: 310

SEQ ID NO: 565 - protein, 396 aa, pAqui_F126
MSFQNPVFIPGPTNMPEVLRKAVDMPTLDHRSPLFGQILHPALAGVKKVLKSETAEIFVFPSTGTGGWETALTNTLSAGDKILAARNGMFSHRWIDMCQRHGLNVQVVETPWGEGLPADRYEEILTADTSHEIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMAAGYANSAYPYTPSVGLLNGLNMACGMLLDEGLENVFARHHRIAEGVRAAVRAWGLELCAVSPDVYSDSVSAIRTPEGFDANKFVSLAAEKYGVAFGTGLGEVAGKVFRIGHLGSLTDVMALSGIATAEMVMADLGLNIQLGSGVAAAQDYYRGNTGASAKAAA

SEQ ID NO: 566 - protein, 396 aa, Oceanicola sp. HL-35
MSFQNPVFIPGPTNIPEFLRKACDMPTIDHRSPLFGQILHPARDGVRKVLKSETAEVFIFPSTGTGGWETALTNTLSPGDKVLAARNGMFSHRWIDMCQRHGLSVEIVETPWGHGLPSDRYEEILTADTGHRIKAVLATHNETATGVKSDIAAVRRALDAAGHPALLFVDGVSSIASMDFRFDEWGVDVAVAGSQKGFMLTAGLAILGFSAKAMAATKTAQLPRTFFDVHDMANGYAKNAYPYTPAVGLLNGLNESCRMLLDEGLENVFARHTRIAEGVRRAVDAWGLELCAASPEVWSDTVSAIRTPEGFNATEIVTHAANTYGVAFGVGLGEVAGKVFRIGHLGSLTDVMTLSGIATAEMCMADLGLDITLGSGVAAAQDYYRGHPAAALKSAA

SEQ ID NO: 567 - protein, 391 aa, Psychrobacter sp. G; identical to SEQ ID NO: 528

SEQ ID NO: 568 - protein, 396 aa, Ensifer meliloti Rm41
MYLQNPVFIPGPTNMPEVLRKASDMPTIDHRSPLFGEILRPALAGVKKVVKSQTASICLFPATGTGGWETAITNTLSPGDRVLVARYGMFSHRWIDMCQRHGLDVSVIETPWGSGAPVDRYEEMLTADKAHQIKAVLVTHNETATGVKSDIAAVRRALDAARHPAMLFVDGVSSIASMEFRMDDWGVDVAVTGSQKGFMLPAGLAITAFSPKALAALETAKLPRTFFDVRDMSKSYENNAYPYTPAVGLLNGLKVSTEMLLAEGLENVFARHNRIATGIRAAVRAWGLELCAMSEDLYSDTVSAIRTPDGFDATSIVTHAAKKYDVAFGVGLGEVAGKVFRIGHLGSLTDVMALSGIATAEMVMADLGLSIKLGSGVAAAQDYYRNNQVSAGRGAA

SEQ ID NO: 569 - protein, 397 aa, Roseovarius sp. MCTG156(2b)
MSDQNPVFIPGPTNIPDRLRRAMQVQTQDHRSPAFVNTLTPVLKGCKTVFGTTNGEIITFPASGTGGWEAAITNTLSPGDKVLVARYGMFSHRWIDMCQRHGLDVQIIECPWGGGAPADRFKEALTADKDHSIKAVLVTHNETATGVRSDIAAVRGAMKSAKHPALLMVDCVSSLGSMPFEMDKWGVDIAVSGSQKGFMLNTGMAILAVSPRALAMMDTAQLPRTFFDFRDMMGANAKGGFPYTPPLQLIYGMAESLNMLFEEGLDNVYARHTRIAEGVRRAVAAWGLKLVAQSPELYSDTVSAVFVPEGFDSNRLTERVFATYGMSFGVGLGEMNGRAFRIGHLGSLTESMMLSGLATLEMAMADLNYPVKLGSGVIAAQEYYRSTAKPILAEKAA

SEQ ID NO: 570 - protein, 396 aa, Rhizobium rhizogenes OK036
MYMQNPVFIPGPTNMPEVLRKATDMPTLDHRSPLFGEILRPALAGVKKILKTEAASVYVFPSTGTGGWETAITNTLSPGDRILAARHGMFSQRWIDMCQRHGLKVDIVEVAWGAGAPADRYEEILAADTAHEIKAVLVTHNETATGVKSDIAAVRQAIDAAKHPALLFVDGVSSIASMDFRMDEWSVDIAITGSQKGFMLPAGLAITAFSPKALAAVETAKLPRTFFDIRDMARSYANNAYPYTPAVGLLNGLKLSTELLLAEGLENVFARHRRIASGIRAAVRAWGLELCAKSEDLYSDTVSAIRTPEGFDATSIVAYAAKTYDVAFGVGLGEVAGKVFRIGHLGSLTDVMALSGIATAEMVMVDLGLNIKLGSGVAAAQDYYRAGRASKVQAAA

SEQ ID NO: 571 - protein, 396 aa, Rhizobium leguminosarum YR374
MYMQNPVFIPGPTNMPEILRKAADMPTLDHRSPLFGEILRPALAGVKKILKTEAASVYVFPSTGTGGWETAITNTLSPGDRVLAARYGMFSQRWIDMCQRHGLKVDIIEAAWGGGAPAARYEEILAADTAHEIKAVLVTHNETATGVKSDIAAVRRAIDAARHPALLFVDGVSSIASMDFRMDEWSVDIAVTGSQKGFMLPAGLAITAFSPKALAAVETAKLPRTFFNIGDMARSYANNAYPYTPAVGLLNGLKLSTELLLAEGLENVFARHRRIASGIRAAVRAWGLELCAMSEDLYSDTVSAIRTPEGFDATSIVAHAAKTYDVAFGVGLGEVAGKVFRIGHLGSLTDVMALSGIATAEMVMVDLGLDIKLGSGVAAAQDYYRDGRASKVRAAA

SEQ ID NO: 572 - protein, 396 aa, Methylobacterium sp. YR668; identical to SEQ ID NO: 355

SEQ ID NO: 573 - protein, 395 aa, Sinorhizobium americanum CCGM7
MSGYNHLFIPGPTNIPERVRQAMNLPMEDMRSPRYPELTLPLFADIKQVFKNKTGRVFIYPSSGTGAWEAAMTNVLSPGDRVLMSRFGQFSHLWVDMAERLGFEVDCLDREWGTGVPVELYAERLAADEAHEIKAVFVTHNETATGVTSDVAAVRAALDACGHPALLFVDGVSSIGSIDFRQDEWGVDCAVSGSQKGFMMPAGLGFLSVSQKALEAARTARHIRCYFSFEDMIKTNDTGYFPYTPPTQLLRGLRAALDLIFEEGLETIFARHHHLANGVRAAVSAWGLKLCATEPKWHSDTVSAIRLPEGIDGVEVIRHAYQAYNTSLGSGLSKVAGKVFRIGHLGSLNEVMVLGALSAAELTLLDCGVKIEPGAGVGAAISQFRSAAVSSAKAA

SEQ ID NO: 574 - protein, 396 aa, Sinorhizobium americanum CCGM7
MYLQNPVFIPGPTNMPEVLRKASDMPTIDHRSPLFGEILRPALAGVRKVVKSDAASIFVFPATGTGGWETAITNTLSPGDRVLVARYGMFSHRWIDMCQRHGLDVSVIETPWGSGAPVHRYEELLTADKAHQIKAVLVTHNETATGVKSDIAAVRHALDSARHPAMLFVDGVSSIASMEFRMDDWGVDVAVTGSQKGFMLPAGLAITAFSTKALAAVETAKLPRTFFDVRDMSKSYENNAYPYTPAVGLLNGLKLSTEMLLAEGLENVFARHNRIATGVRAAVRAWGLELCASSEDLYSDTVSAIRTPDGFDATSIVTHAAKKYDVAFGVGLGEVAGKVFRIGHLGSLTDVMALSGIATAEMVMADLGLGIKLGSGVAAAQEYYRKNQVPADRGAA

SEQ ID NO: 575 - protein, 396 aa, Palleronia marisminoris DSM 26347
MSFQNPVFIPGPTNIPERLRKACDMPTIDHRSPLFGQILHPAREGVRKVLKSNSAQVFIFPSTGTGGWEAALTNCLSAGDKVLAARNGMFSHRWIDMCQRHGLKVEIIETPWGHGVPADRYEEILAADENHEIKVVLATHNETATGVKSDIAAVRRALDAAGHPAMLFVDGVSSIASMDFRFDEWGVDVAVAGSQKGFMLAPGLAITAFSDKAMMATEAATLPRTFFDVKDMAKGYANNAYPYTPAVGLLNGLNEACGMLLDEGLENVFARHHRIAEGIRAAVGAWGLELCAVSPEVYSDTVSAIRTPEGFNATDIVSHAASAYGVAFGTGLGEVAGKVFRIGHLGSLTDVMALSGIATAEMVMADLGLDITLGSGVAAAQDCYRGNRLNADKAAA

SEQ ID NO: 576 - protein, 396 aa, Paracoccus aminovorans DSM 8537
MTSQNPIFIPGPTNIPEEMRKAVDMPTIDHRSPVFGRMLHPALEGVKKVLKTTQAQVFLFPSTGTGGWETAISNTLSPGDKVLAARNGMFSHRWIDMCQRHGLDVTYVETQWGEGIPADRFEEILTADKGHEIRAVLATHNETATGVKSDIAAVRRALDAAQHPALLLVDGVSSIGSMDFRMDEWGVDVAVTGSQKGFMLPPGLAIVGFSPKAMEAVESARLPRTFFDIRDMATGYARNGYPYTPPVGLINGLNLSCERLLSEGLENVFARHHRIASGVRAAVEAWGLKLCAVRPELYSDSVSAIRVPEGFDANLIVSHALETYDMAFGTGLGQVAGKVFRIGHLGSLTDAMALSGIATAEMVMADLGLPIKLGSGVAAAQDHYRRTTAAAQKKAA

SEQ ID NO: 577 - protein, 396 aa, Yangia pacifica CGMCC 1.3455; identical to SEQ ID NO: 514

SEQ ID NO: 578 - protein, 396 aa, Roseovarius indicus DSM 26383
MNLQNPVFIPGPTNIPEALRKACDMPTIDHRSAVFGEILHPLRAKLREVLKSESAEIFLFPATGTGGWETALTNTLSPGDKVLAARNGMFSHRWIDMCQRHGLDVHVVEVPWGEGIPAERLGGILAADAGHSFKAVLATHNETATGVQSDIGALRRAMDAAGHPAMLFVDGVSSIASMEFRFDDWGVDVAVTGSQKGFMLPAGLAITAFSPKAVAASVTAGLPRTFFDIRDMDKGYAQGGYPYTPPVGLINGLNAACDMLLAEGMEDVFARHARIANGVRAAVRAWGLELCAATPDVWSDTVSAIRTPPGVNATDIVTHAADAYGTAFGTGLGEVAGKVFRIGHLGSLTDVMALSGIATAEMCMADLGMKIELGSGVAAAQEVYRATHARKQKDAA

SEQ ID NO: 579 - protein, 395 aa, Jannaschia rubra DSM 16279; identical to SEQ ID NO: 367

SEQ ID NO: 580 - protein, 396 aa, Rhizobium etli bv. phaseoli IE4803
MYGQNPVFIPGPTNMPEILRKAADMPTMDHRSSMFGEILHPALTGVKQVLKTETASVFIFPATGSGGWETAITNTLSPGDRVVAGRHGMFSQKWIDMCRRHQLKVDAIECSWHDGVPLAQYEEFLNADKAHEIKAVLVTHNETATGVKSDVAAVRRLLNAANHPALLLVDGVSSIASMDFRMDEWGVDVAVTGSQKGFMLPVGLAITAFSPKAIAALDTAKLPRAFFDVRDMAKGYSTNGYPYTPSVGLLNGLKVSTELLLQEGLENVFARHRRIASGVRAAVRAWRLELYAAREELYSDTVTAVQTPAGFDASRFVTHAATKYDVAFGAGLGDVAGKVFRIGHVGSMTDVMALSGIATAEMVMVDLGLNIKLGSGVAAAQAIYRNSHTSAVEMVA

SEQ ID NO: 581 - protein, 397 aa, Roseivivax sediminis DSM 26472
MPGFSHLYIPGPTNLPEAVRRAMNVPMEDMRAPDFPDLTRPVFEKAQKVFRNSEGRVFIYPSSGTGAWEAAIQNTLSPGDKVLMSRFGQFSNLWVDMAQRMGLDVDVIDCEWGEGVPVDQYAERLKADKTHDYKAVFATHNETATGVTSDIKGVREALDAAGHPALLMVDGVSSVGSIEFDQDAWGVDCAVSGSQKGFMLPAGLGILSVSKWALEAHKTAEFPRCYFSFEDQIRMNDTGYFPYTPATQLLRGLDVSCDMLLDEGLENVWARHRRLASGVRAAVEAWGLTLCAARPELWSDTVSAIVVPDDRDARDVIAAAYAKYDTSLGSGLANVAGKVFRIGHLGWLNEGMVCTALSAAEMAMIECGFEIEAGSGVGAAIRLFATSDAPQMKIAAE

SEQ ID NO: 582 - protein, 396 aa, Roseivivax sediminis DSM 26472
MSFQNPVFIPGPTNIPERLRKACDMPTIDHRSPLFGQILHPAREGVQKVLKSDSAEVFIFPSTGTGGWETALSNTLSPGDKVLAARNGMFSHRWIDMCQRHDLDVTIVETPWGEGLPAARYEEVLAADTGHEIKAVLATHNETATGVKSDIAAVRRALDTAGHPAMLFVDGVSSIGSMDFRFDEWGVDVAVTGSQKGFMLSAGLAIVGFSDKAMQATKTARLPRTFFDVHDMAKGYANSAYPYTPAVGLLNGLNEACGMLLSEGLDNVFARHTRIAEGVRAAVGAWGLDLCATAPEFYSDTVSAIRTPEGFDATRVVTHAADVYGVAFGVGLGEVAGKVFRIGHLGSLTDVMTLSGIATAEMCMVDLGLDIELGSGVAAAQRIYRADAALARKDAA

SEQ ID NO: 583 - protein, 396 aa, Agrobacterium sp. KFB 330
MSTQNPIFIPGPTNIPEVLRKAVDMPTIDHRSPLFGNILHPALEGVKAILKTSKAEVFVFPSTGTGGWETAITNTLSAGDKVLATRNGMFSHRWIDMCQRHGLDVQVVMQEWGEGVPADTFEEILTADKGHEIKVVLATHNETATGVRSDIAAVRRALDNAKHPALLFVDGVSSIACYDFRMDEWGVDVAVTGSQKGFMLPPGLAIVGFSQKALAATGSARLPRTFFDVRDMAKGYAANGYPYTPPVGLLNGLKVATDMLLDEGLENVFARHHRIAEGVRCAVSAWGLKLCAARSDLYSNSVSAIRTPEGFDANKIVAHALNTYGVAFGTGLGDVAGKVFRIGHLGSLTDVMALSGIATAEMVMADLGLPVNLGSGVAAAQQSYRQSAGIAQRKAA

SEQ ID NO: 584 - protein, 396 aa, Leisingera sp. ANG-DT; identical to SEQ ID NO: 549

SEQ ID NO: 585 - protein, 396 aa, Methylobacterium sp. ME121; identical to SEQ ID NO: 337

SEQ ID NO: 586 - protein, 392 aa, Litoreibacter meonggei DSM 29466
MSFQNPVFIPGPTNMPEAVRQACYMPTIDHRSPTFGKILHPCLDGVRQVLKSKDAKIFIFPSTGTGGWETALSNTLNKGDKVLAARNGMFSHRWIDMCQRHGLDVHIVETPWGEGVPAGKYEEILKADKNHEIKVVLATHNETATGVKSDIAAVRKALDAAGHPAMLFVDGVSSIASMDFRFDEWGVDIAITGSQKGFMLPAGLAIIGFSSKAIAASANATLPRTFFDIKDMQKGYDANAFPYTPPVGLMNGLKLSLDMLLDEGLENVFARHHRIAEGVRKAVSAWGLELCAASPDLYSDTVSAIRTPEGFNATDIVTHAADKYDVAFGVGLGEVAGKVFRIGHLGSLTDVMTLSGLATAEMCMVDLGLDVKLGSGVAAAQEYYRTNPAAGK

SEQ ID NO: 587 - protein, 392 aa, Litoreibacter halocynthiae DSM 29467
MSFQNPVFIPGPTNMPEAVRQACYMPTIDHRSPTFGKILHPCLDGVRKVLKSKDAKIFIFPSTGTGGWETALSNTLSKGDKVLAARNGMFSHRWIDMCQRHGLDVHVVETPWGEGVPTDKYEEVLKADKNHEIKVVLATHNETATGVKSDIAAVRKALDAAGHPAMLFVDGVSSIASMDFRFDEWGVDIAITGSQKGFMLPAGLAIIGFSGKAIAAAENSDLPTTFFDIGDMQKGYNANAFPYTPPVGLMNGLKLSLDMLLDEGLENVFARHHRIAEGVRAAVSAWGLELCAASPDLYSDTVSAIRTPEGFNATDIVTLAAEKYGVAFGVGLGEVAGKVFRIGHLGSLTDVMMLSGLATAEMCMVDLGLDVKLGSGVAAAQEYYRTNPTAGK

SEQ ID NO: 588 - protein, 396 aa, Roseivivax lentus DSM 29430
MSTQNPVFIPGPTNIPERLLSAMHVQTRDHRAPDFVETFAPVLNDTKRVFGTKDGTVITFPASGTGGWEAAVTNTLSPGDKVLVARYGMFSHRWIDLCQRHGLDVQIIECPWGAGAPADKFESVLSEDKGHEIKAVLVTHNETATGVKSDIAAVRGAMDAASHPAMLFVDCVSSLASMPFEMDAWGVDIAVSGSQKGFMLATGMAILGVSPKALDAMEAAKLPRTFFDFRDMTKANASGGFPYTPPLQLIYGLRESLKMLFEEGLENVYDRHFRLAEGVRRATKAWGLDLVAQSPDLYSDTVSAIYVPKGFDSNALTQHAFDAYGVSFGIGLGEMNGKAFRIGHLGSLTDVMVLSGLGAIEMAMADLNYPITLGSGVAAAQEYYRSTHAPAVRSAA

SEQ ID NO: 589 - protein, 392 aa, Rhodovulum sulfidophilum DSM 2351
MHASNPIFLPGPTNLPEPLRRACDIPTMDHRSAAFGPILAAAKEGVARILGLSGGEVALFPATGTGGWEAAVTNALRPGDKVLAARHGMFSRKWIDLCQRHGLEVEIVERPWGEGVPVEEFAAALAADGGHQIRAVLVTHNETATGVTSDVAAVRAAMDAAGHPALLMVDGVSSIGSIEFRMDDWGVDLAVAGSQKGFMLPAGLAIIGISAKARQAMETAGLPRCFFDIRDMEDGNYPYTPPVGLINGLAVSTGLLLEEGMENVRARHHRIAEGVRRAVAAWDMTTCAAAPELCSDTVTAIVTPEGFDAGRIVRHAAEAYGVAFGGGLGEVAGKVFRIGHLGLMSDVMALSGIATAEMAMVDLGLPVRLGSGVAAAQEHYRNSRTAPVQAAA

SEQ ID NO: 590 - protein, 396 aa, Roseobacter denitrificans DSM 7001; identical to SEQ ID NO: 305

SEQ ID NO: 591 - protein, 396 aa, Leisingera sp. ANG-Vp
MSFQNPVFIPGPTNMPEALRKAVDMPTLDHRSPLFGQILHPALAGVKKVLKSENAEIFVFPSTGTGGWETAITNTLSADDKVLAARNGMFSHRWIDMCQRHGLDVQIVETPWGEGLPADRYEEILTADTAHEIKVVLATHNETATGVKSDIAAVRRALDAAGHPALLFVDGVSSIASMDFRMDEWGVDIAVTGSQKGFMLPPGLAIVGFSPKAMQAVEAATLPRTFFDIKDMALGYSNSAYPYTPSVGLLNGLNMACGMLLDEGLENVFARHYRIAEGVRAAVRAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNQASSTKAAA

SEQ ID NO: 592 - protein, 397 aa, Marivita hallyeonensis DSM 29431
MSFQNPVFIPGPTNIPESLRKACDMPTIDHRSPLFGTILHPARKAVQAILKSTSAEVFIFPSTGTGGWETAITNTLSEGDTVLVARNGMFSHRWIDMCERHGLELIIVDVAWGQGIPADRFEEILTGDTAHRIKAVLATHNETATGVVSDIGAIRHAMDAAGHPAMLMVDGVSSIASMDFRFDAWGVDVAVTGSQKGFMLPPGLAIVGFSEKAMDATKTAGLHRTFFDVHDMMKGYANSAYPYTPAVGLMNGLNEACRMLMDEGLETVFARHHRIAEGVRRAVWAWGLELCAESPDVYSDTISAVRTPNGFNATDIVTHAASTYGVAFGVGLGDVAGKVFRIGHLGSLTEVMTLSGIATAEMCMVDLGLDIKLGSGVAAAQEYYRYGSEIEQKVAAQ

SEQ ID NO: 593 - protein, 396 aa, Labrenzia alba CECT 7551
MSFQNPVFIPGPTNMPEALRKACDMPTLDHRSPLFGEILRPVLAGVKKILKTETAEVFIFPSTGTGGWETVLTNTLSADDKILAARNGMFSHRWIDMCQRHGLKVEVVETPWGAGLPADRYEEILTADTNHEIKAVLATHNETATGVKSNIAAVRRALSAAKHPALLLVDGVSSIASMDFRMDEWGVDAAVTGSQKGFMLPAGLAIVALSPKAQAAIETAKLPRTFFDVRDMMKAYATNAYPYTPAVGLLNGLKTSCDMLLGEGLENVFTRHHRIAEGVRSAVRAWGLELCAKTPDVYSDTVSAIYTPEGFNATDIVTHAAGKYGVAFGVGLGEVAGKAFRIGHLGSLTDVMTLSGLATAEMVMVDLGLDIKLGSGVAAAQEYYRNEEALASKEAA

SEQ ID NO: 594 - protein, 396 aa, Thalassobius abyssi DSM 100673
MSFQNPVFIPGPTNMPEALRRAVDMPTLDHRSSLFAEMLHPARAGVKKVLKSETAEVFFFPSTGTGGWETALTNTLSPGDTILAARNGMFSHRWIDMCQRHGLNVQVVETEWGLGLPADRFEEILSSDTSHQIKVVLATHNETATGVKSDIAAVRKALDAAGHPAMLYVDGVSSIASMDFRMDEWGVDIAVTGSQKGFMLPAGLAIVGFSPKAMQMVEAATLPRTFFDIRDMGRSYAANGYPYTPAVGLLNGLNKSCDMLLAEGLENVFARHHRIASGVRAAVHAWGMELCAASPDLYSDSVSAIRTPDGFDATQFVTHAADTYGVAFGVGLGDVAGKVFRIGHLGMLTDVMALSGIATAEMCMADLGLDIRLGSGVAAAQEVYRGSTAKPLKEAA

SEQ ID NO: 595 - protein, 396 aa, Roseovarius indicus B108 cultivar; identical to SEQ ID NO: 578

SEQ ID NO: 596 - protein, 397 aa, Litoreibacter ponti DSM 100977
MRTSQNPVFIPGPTNMPEHLRKAADMATLDHRGPAFAGMLKPALEGVKTILGTTDGEVILFPATGTGGWEAAVSNTLSPGDTVLAARFGMFSHRWIDLCQRHGLNVQIIETPWGEGAPIAAIEEALTNDKEHRIKAVLATHNETATGVKSDIAAVRGAMDAAGHPAMFFVDGVSSIASMPFHMDDWGVDVAITGSQKGFMLPAGLAICGISPKAVAAMETAKLPRTFFDFRDMRDSMAGGGFPYTPPVGLIHGLSVAVEDLLTEGLDNVYARHTRIATGVRAAIEAWGMTPYAKTPDLFSDTVTAVKVPDGFNGTDVVTRAASEYDMAFGVGLGEVAGKVFRIGHLGQLTDAMMLSGLSVAEMCMADLGYPIELGSGVAAAQSVYRHGDNVLALAAE

SEQ ID NO: 597 - protein, 399 aa, Yangia sp. CCB-MM3
MSFQNPVFIPGPTNIPESLRKACDMPTIDHRSPLFGQILHPARERVRRVLKSASAEVFIFPSTGTGGWETALTNTLSPGDTVLAARNGMFSHRWIDMCQRHGLTVEVVETAWGEGLPADRYAEILAADKSRRIKAVLATHNETATGVRSDIAAVRRALDDVDHPALLFVDGVSSIASMDFRFDDWGVDVAVTGSQKGFMLPPGLAITGFSEKAMAATQTAKLPRTFFDVHDMAKGYANDAYPYTPAVGLLNGLNEACRMLLDEGLENVFARHHRIAEGVRAAVGAWGLELCAASPDLYSDTVSAIRTPEGFNATDIVSHAAQTYGVAFGTGLGEVAGKVFRIGHLGSLTDVMALSGLATAEMCMKDLGLKITLGSGVAAAQEVYRTSTATARTASQEAA

SEQ ID NO: 598 - protein, 393 aa, Granulosicoccus antarcticus IMCC3135
MNGQNPIFIPGPTNIPDRLRAAMNVQSSDHRAPDFKEIFLPVLADVKKIFKMSGGEVIIFPASGTGGWEASVTNTLSPGDKVLVARYGMFSHRWIDLCQRQGLDVEIIECAWGSAAPADLFAQRLAADPEGRIKAVLVTHNETATGVRSDIAGVRKAMNASDHAALLFVDCVSSLGCMDFRMDEWGVDLAVAGSQKGFMLNTGMAIVGVSDKALAAMDSARCPRCFFDFRDMLAANQKGGYPYTPPLQLIHGLRASVDMLLEEGLDAVFARHFRLAEGVRQAVAAWGLTLCAQSADLYSDTVSAIYVPEGLNSDALTDHAYHTYDVSFGVGLGEMAGKAFRIGHLGSLSDLMVLSGLAGIEMAMKDLDYPIELGSGVAAAQAYYRKTAAGNTQ

SEQ ID NO: 599 - protein, 397 aa, Tateyamaria omphalii DOK1-4
MSFQNPVFIPGPTNIPESLRKSCDMPTIDHRSPLFGGILNAARDGVRQVLKSATAEVFIFPATGTGGWETALTNTLSPGDTVLAARNGMFSHRWIDMCQRLGLTVRVVETPWGQGIPHDQFAEILAADTSHEIKAVLATHNETATGVTSDIAAVRAAMDGSDHPAMLFVDGVSSIGSIDFQFDDWGVDVAVTGSQKGFMLPAGLAIVGFSAKAMAAQPSAQLPRTFFDIRDMADGYAAGAYPYTPAVGLMNGLSHACTMLLSEGLDTVFARHHRIASGVRAAVSAWGLELCAASPDLYSDTVSAIRTPAGFDASRIVSHAATTYGVAFGGGLGEVAGKVFRIGHLGSLTDVMALSGIATAEMCMADHGLDITLGSGVAAAQDVYRAHGAANVQKDAA

SEQ ID NO: 600 - protein, 281 aa, Silicibacter pomeroyi DSS-3 megaplasmid
MATEKRKRGRPKSFADKSEQNTNQSLDRAIDILECLASARGLALSEVAERLDLAPATVYRALHTFESRRLTEIDPETQTWHIGPDLFRLGSAFLLRSSLVERARPVLRKLMEVTGETANIGIERDGEILFLSQVETQSNIRAFFQPGTRAPLHASGIGKALLSQYDRARIDRLLPEMRLEQFTMKTRFDKEQLLSELDLIHRRGWALDDEERTHGMRCVAAPITDFTGEAIGGISVSGPSDRMPDARLTEIGNIVRDAALDLSRRLGAPLSVSIRPSTDEA

SEQ ID NO: 601 - protein, 280 aa, Silicibacter sp. TM1040
MDSQENASRATRRARGRPRDWHDKTAQNTIKSLDRAMEVFEYLSQAQGKPLTMIAEEMGQSPATVYRILVTLEGRGLVDFDAEEQLWHIGAQAFVIGARFLRRTSLVDRARPILRRLMEDTGETANLGVEKEGHVLFLSQVETHASIRAFFPPGTLSQMHASGIGKALLAEMDGSRLDRLLAATRLEIFTDHTITDPEALKADLAAIRAQGFAVDNEEKNAGMRCIAAPVFDMNREAIAGISVSGPTSRISVESIAELSRPVIEAAQQLTVAIGGDPAAL

SEQ ID NO: 602 - protein, 272 aa, Loktanella vestfoldensis SKA53
MQHDIRKTRGRPKAWDDKAVQNTVKSLDRALEVLIALGEMQGGTLSEIATNLHQSPATVYRVLTTFQGRGFVDFDRQAQVWSIGAAAFLTGSQFLRRTSLVERARPIMRDLMEATGETANLGIERDGNVLFLGQVETHATIRAFFPPGTVSAMHASGIGKALLAHMDDARQRRVLAAGKLEQFTPHTLTNPEAMIADLHAARARGYAFDGEERNLGMRCIAATVHDVSGDAVAGLSVSGPTSRITDDKIAPLAQAVTEAAARLTAAIGGAPR

SEQ ID NO: 603 - protein, 279 aa, Paracoccus denitrificans PD1222 chromosome 2
MSVQIRKRGRPRGRAGGLGAEDSGGIRALDRALDILDLIAVSSGLTLTEIAQRLDMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPLDLKRMLREMRLERFTDMTLTDPAALVEDLVQIRARGYALDNEERTPGMRCIAAPIFDLAGEAAAGISVSGPTLRMSDARLSAMSDAVIEAARELSFGMAPRKDAGERA

SEQ ID NO: 604 - protein, 285 aa, Roseobacter denitrificans OCh 114
MNTQKRPRGRPKSQFKESTAGTMQSLDRALGVLVAVAKSEQATLTDLSLSLGVPTATTHRILTTLQKHRFVAFNEEHQSWSIGIEAYRTGASFMNRTSLTEVSRPIMRLLMEKTGETANLAIPDGAEVVFVEQIETLHPIRAFFARGARTSMHASGIGKAILSTMSEEHVRRLLISSGLQAFTDNTLTSPASLFADLTETRARGYSYDREERYLGMSCIGSAIFDERGEACGGVSISGPSTRFDSLRVPELGAIVAEAAGQISQLIGGRGREPASSLPASNTPTA

SEQ ID NO: 605 - protein, 276 aa, Ahrensia sp. R2A130 contig00014
MKMDIEARKRGRPRLFEGRDEDKVVRALDKGLVVLRVISESDGLSLSEIAETSEVSAPTAYRSLITMQMHGLVAFDDHTQLWRIDVEAFRVGSAFLSNSAVSEQARPVMQRLMESTGETSNLGILSDREVVFLSQAETHEPIRAFFRPGTRSPVHTSGIGKALLAFRPREEAQRLAEQLDMKPFTDNTICSADDLMKAVDEMVAQGFAVDDEERTLGMRCVAAPIFNSFGEAVAAISTSGPSVRVTKDRVLALGKQVRAAADEISRNIAGRIVDFS

SEQ ID NO: 606 - protein, 280 aa, Dinoroseobacter shibae DFL-12
MKDQTPSPRRSRGRPKNAFSDGQSSTIQALDRGLSVLSALARDGGGTLSDVSMRLGMPASTAHRVLATLEKHGYVDMDEASQTWRVGLEAFRVGTSFMQRTNLLEVGRASMRTLMEQTGETANLGILDNDHVVFIGQVETHNPIRAFHRPGSSGPMHASGIGKALLAAMPQGAVENLFRRTGLQQFSPKTLTDPEALLSDLRITRKRGWSFDNEERYEGMCCVAAVIYDSFREPIAGISVSGPSARFAPGALPALGAAVQTAARDVTAQIGGEMPQIAAE

SEQ ID NO: 607 - protein, 292 aa, Octadecabacter arcticus 238
MPDEPDSTVKHDHSRTQTRTQTRARGRPKAWRDKTEQNTIKSLDRALEVLSRLGDLEEATLSELANDLGQSPATIYRVLTTYRAHAFTDFDETRQVWSVGAGAFLTGAKFLRRTSMVERARPHLRRLMEATEETANLGVAKDADVLFLSQSETHHAIRAFFPPGTLSPMHASGIGKALLAQWPQKRVDAMLAARAPEQFTEYTLITRDALMDDLRETQLRGYSFDGEEKNIGMRCIAAPVFDVHGDAVAGLSISGPVARITDARIAPIGTLVRAGADALTRELGGVSPQPPG

SEQ ID NO: 608 - protein, 277 aa, pDaep_A276
MPQAPRRKGRPKNFDSASNPPTIQSLDRALDVLDALAGASGMTLTELSTALDQSAATMYRVLATLEARQIVEMEPQSQTWHIGAMAFRLGSAFLRRSSVIERARPVMRELMEATGETSNLGIERGGDVMFVSQVETYESIRAFFPPGTTSPMHASGIGKALLSCFGEDQLTRFLRGRTLTEFTEKTLTSAEALREDLAQIRRRGWSFDDEEKAPGMRCVAAPVFGMQGEVLAGISVSGPTSRMPDTRISEIGALVRGAAEKLSYGLGAPAADQAAPG

SEQ ID NO: 609 - protein, 276 aa, Paracoccus sp. J56
MSVQVRKRGRPRGRAGGFGAEDSGGIRALDRALDILDLIAASNGLTLTEIAQRLEMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHASMMDLKRMLREMRLERFTGMTLTDPQALLEDLARIRARGYALDNEERTPGMRCIAAPIFDLAGEAAAGISVSGPTLRMSDERLAAMSEAVIAAARELSFGAPPAADGG

SEQ ID NO: 610 - protein, 278 aa, Paracoccus aminophilus JCM 7686
MIHGKENQPRKRGRPRGSGNSQAEDKGGVRALDRALDLMDILASEQGMTLSEIAQRMGLAPSTVHRVLTTLDARAVVESDPLTQAWHLGPTAFRYGSAFMRRSGLIERSRPVMRRLMELTGETANLGIRNGNAVLFIGQVETHETIRAFFPPGTRSPLHSSGIGKALLAFVRPEVLRTFFHEAVLDRFTPTTLTERADLVADLTETRARGYSIDNEERSPGMRCIAAPIFDMFGEPVAGISVSGPSHRMTEARLSDIGSAVVEAARALSLSGPAEDNF

SEQ ID NO: 611 - protein, 269 aa, Rhizobium rhizogenes YR147
MPAEPRRRGRPKAFNGPQTQNTIQALDRALDVLDALATPEGKTLSELAGQLGQSAATMHRVLATLERREFVEISPDRQVWHIGPEAYRLGAAFLRRSNVVERSRPIMRELMLETGETSNLGIEKDGNVLFISQVETHESIRAFFPPGTLSPLHASGIGKALLSTYDDNRLSALFKKKEFERFTDNTVRSFDQLREELQKTRDRGYSFDDEERTKGMRCVAAPILNVHGEAVAGISVSGPIHRLPDADIHQIGERVKSAARMVSRRLGAP

SEQ ID NO: 612 - protein, 270 aa, Roseinatronobacter thiooxidans DSM 13087
MAETKPRGRPRAFHDKTEQNTVQSLDRALGILRVLSESSGLTLTELAQAAHQSPATVYRVLSTYQTHGMVELEAQGQRWHIGAGAFRIGSAFLRRTKLAERAREAMQTLMRESGETANLGVEEQDEVLFLTQVETHEAIRAFFPPGTRSPMHVSGIGKALLAYYPPARVARITALGLPGFTPASLTDAARLENDLTRTRARGYAIDNEERTEGMRCIAAPIFNAHAEPVAGLSISGPVFRLSLERAREMGELVRRAAAGVTEATGGRVPE

SEQ ID NO: 613 - protein, 281 aa, Citreicella marina DSM 26424
MEFQDNAARGPRKARGRPRDWEDKTAQNTIKSLDRAMEVFEFLSERQGIALSAIADDMGQSPSTIYRVLVTLEGRGLVEFDAEEQLWHIGPRAFMIGSRFLRRTSLVDRARPVMRALMEATGETANLGVEKEGKVLFLSQVETHANIRAFFPPGTLSAMHASGIGKALLAQMDDARLARRLEGGLDAFTEKTVTDRDRLMADLRQIRARGYSCDDEERNIGMRCIAAPVFDINGEAIAGLSVSGPTSRVTAEALHKLSRPVVEAARMLTEAIGGKVTPPRV

SEQ ID NO: 614 - protein, 275 aa, Ruegeria marina CGMCC 1.9108
MNTPKRARGRPRSAFSESGGATLQSLDRALGLLATVARFGHATLTDLALAQGLPAATAHRILTTLQKHGFVDFDRHSQEWMIGIEAYRTGSAYLRRAGLTEIGQPILRALMEKTGETANLAVPDGTEVVFIAQVETAHPIRAFFPAGTRSPMHASGTGKAILAMMPPERARTLLQKAGLPVFTSKTLSTPNALFQDLDRTRTRGWSYEADERHDGMSCIGAAIFDENGLPCAGISISGPSGRFKPDSLDRLGQAVAEAGAEITRLTGGTAPDRSS

SEQ ID NO: 615 - protein, 272 aa, Thalassobacter sp. 16PALIMAR09
MKSKRGRPKAFHDTTEQNTIQSLDRALHVVNYVAQSPDRSLTEIATALEQSPATVYRVLVTLAGHQMVEMDPAEQTWHIGAGAFRLGSAFLRRSSLVERARPVMRHLMERTGETANIGIEKNGRVLFLGQVETHESIRAFFPPGTQAPMHTSGIGKAILSHFGPERVHKIFESEAETYFTAHSLGTLDALTDDLALTRTRGFAVDNEERTLGMRCIAAPIFNSEGEAIAGLSISGPVVRISQDRVPEISRAVTEAAHKLTEAIGGPAIPVES

SEQ ID NO: 616 - protein, 268 aa, Salinihabitans flavidus DSM 27842
MPPKLRQRGRPKAFHDQTEKTRIQSLDRALDVLEALAAQGGQTLTEIAEDLGQSPATIYRILTTLEVRGMAEADPGDQTWHVGPGAFRLGSAFLRRASVVERARPVMRSLMESTGETANLAIEKGGKILFLSQVETHETIRAFSPPGTQSPLHASGIGKALLAFADPARIDGFLRDTLEAFTPKTITDPAAMRADLDRIRVCGYSFDDEERTEGMRCIAAPILNFYGEAVAGISVSGPTHRMREDRIEHLGALISRAAADLSRALGAP

SEQ ID NO: 617 - protein, 268 aa, Paracoccus alcaliphilus DSM 8512
MAEPTRRRGRPRSTTETSGTIQALDRALDILDLLAAHPGLTLSEVAEKMGQSPSTVHRVLHTLAARGVAESDTATQTWHIGPATFRLGSAFMRRSGIVERARPVLRTLMEHTGETANLGILNGDAVMFVSQAETHETIRAFFPPGTRSPLHASGIGKALLAFGRPETLQVLLQNGELQRFTDKTLTTREALTEDMARIRNRGFSFDDEERTRGMRCIAAPVFDLTGEAIAGVSVSGPTHRIGPEHVKTLGAVVAAAASELSAAMGADR

SEQ ID NO: 618 - protein, 267 aa, Paracoccus alcaliphilus DSM 8512
MWNESTQMEKTGTVQAVERALTLLELLAGFPQGARLTLLAKRAGLAPSTAHRLLTTLERRGFAQFDPAGSRWRVGRRAFTVGVAFTRWQSFITAATPFLRRLRDLSHETANLGVLEDGEVITVAQVESREIIRAIASPGGRAPVMNSGMGKAIVATWPDEAIEAFIHRHGLHPVTRHSLTTLTEVMAEIALIRRRGYAFDDEEFIYGMRCAAAAVWDHSGQPVGAISVSALASRLPVAGMAEMGKAVRGVAGELSLTMGGKPPPIPA

SEQ ID NO: 619 - protein, 251 aa, Paracoccus sp. PAMC 22219
MADPTRRRGRPCNDGPDRPLTVQALDRALDMLDLLSLHPGLTLSEVAQRTGLPASATHRILQTLALRGMVERCDATQCWAVGPSSFRLGAAFLRRSGLIARARPILQALVARTGETANLGILSDDGVLFVAQVESDQPIRVAFPPGTRACLHASGIGRAMLAVNARTAPEGLCRDLARIRRRGFAFDDQGRMAGMRCVAAPIVDLSGRAVAGLSINAPAHRIGGRQVTAIGAAVAEAAARLTAVTGEQLHL

SEQ ID NO: 620 - protein, 281 aa, Paracoccus sp. PAMC 22219
MQQPVRKRGRPRGGKADQPAASIQALDRGLDVLEALAAHEGITLTGLSTHLDQSPATMHRVLATLEHRRYVENNPDRQEWFIGPEAFRLGSAFLRRTNIAERSRAVMRDLMAQAGETANLGIERDGDVLFVSQVETHQTIRAFFPPGTRSPLHASGIGKALLAAFDPTRLAVVMRVAPFTRFTDKTIADADALHAEIALIRRRGFAVDDEERTLGMRCVAASIVNSYGEAVAGVSVSGPTNRMTDAAVDRIGGMVATAAAQISANLGSGQGGPGGRIPLTP

SEQ ID NO: 621 - protein, 266 aa, Paracoccus sp. PAMC 22219
MADPTRKRGRPRKTLPDAPGTVQSLDRALDLLDLLAAQPGLTLSEVAERSAQPPSTVHRVLHTLAARGMAESDPATQAWNIGPQAFRLGSAFMRRSGLVERARPIMRALMEHTGETANLGILQGDSVLFLSQVETSETIRAFFPPGTRSPLHASGIGKALLAFRPDSVAALGPLARFTDTTLTDPEALEADLARIRHRGFSFDDEERSRGMRCIAAPVFDLSGEAIAGISVSGPTHRIGAEHVKTLGAVVAAAAASLSDALGGPTP

SEQ ID NO: 622 - protein, 275 aa, Loktanella sp. 5RATIMAR09
METEVKRGRGRPKAWDDKGAQNTIKSLDRALEVLVQLGEMQGSTLSEIAGALGQSPATVYRVLTTFQGRGFADFDPQSQVWSIGPAAFLTGSMFLRRTSLVERARPIMRDLMEATGETANLGIERDGQVLFLGQVETHATIRAFFPPGTASAMHSSGIGKALLSRMDDKRQRAVLAAGKLEQFTPHTLTDPEAMIADLHATKARGYAFDGEERNIGMRCIAAPVYNVFGEAVAGISVSGPTSRITDDRIVALAEDVMEAATRLTRAIGGNHRPAS

SEQ ID NO: 623 - protein, 279 aa, Octadecabacter temperatus SB1 null replaces 100945
VSDNPISSATRARGRPKAWTDKTDQNTIKSLDRALQILSRLGDMEEATLSELSSALSQSPATVYRVLTTFQAHDFTEFNPTRQVWSVGAGAFLTGAKFLRRSSMVERARPHLRRLMEATEETANLGIAKGANVLFLSQSETHHAIRAFFPPGTVSPMYASGIGKALLALWSEKRVNALLAAQKIEQFTEHTLTDAAALTADLAETRARGYSFDAEEKNIGMRCIAAPVFDIYGEAIGGLSISGPVARITDNRISDIGAIVRSEANALTRTLGGVPPTEV

SEQ ID NO: 624 - protein, 271 aa, Leisingera sp. ANG-S
MSQPPRRKGRPKSFDSASQPATIQSLDRALDVLDALAGASGMTLTELSSALDQSAATMYRVLATLEARRIVEMEPQSQTWHIGAMAFRLGSAFLRRSSVIERARPVMRELMEATGETSNLGIERGGDVMFVSQVETHESIRAFFPPGTTSPMHASGIGKALLSCFGEDQLARFLRGRTLERFTEKTLTSAETLRADLAQIRNRGWSFDDEEKAPGMRCVAAPVFGMQGEVLAGISISGPTARMPDGGIYGIGTLVKDAAQKLSQGMGAPAA

SEQ ID NO: 625 - protein, 269 aa, Sinorhizobium fredii CCBAU 83753
MQPAKRRRGRPKGFNAPESQTVIQSLDRALDVLEAVAWPEGLTLSELAAHLGQSAATMHRVLATLERREFVEISPDRQVWHIGPEAYRLGSAFLRRTNVVERSRAIMRELMLETGETSNLGIEKDGNVLFISQVETHESIRAFFPPGTLAPLHASGIGKALLSTYDDSRLASLFQKATLERFTENTVRSFAQLKEELRATRDRGYAFDDEERTQGMRCVAAPILNVHGEAVAGISVSGPTHRMPDKRVQQIGERVRSAAKTVSRRLGAP

SEQ ID NO: 626 - protein, 282 aa, Sinorhizobium fredii CCBAU 83753
VTEYSAVAVVSEQTKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPFLKRLMEESGETANIGIEDDGDVVFISQVESHAPMRAFFRPGRRGPSHASGIGKAILSTWSDTEIAKTLGGKTLTHFTDRTLKTLPALIRNIQEIRNRGWSIDDEEHTLGMRCIAAPLFNEYGEAIGGISISGPSVRIDDDRLETLGSLVRRTADELTRAIGGHRPGES

SEQ ID NO: 627 - protein, 282 aa, Defluviimonas indica DSM 24802
MKSQANASGGGRRARGRPRGWDDKTAQNTIKSLDRAMEVFEYLSEAQGKPLTMLADEMGQSPATVYRILVTLEGHRLVEFDHEEQVWHIGTGAFVIGARYLRRTSLVDRARPIMRKLMEATGETANLGIEREAAVLFLSQVETHANIRAFFPPGTLSPMHASGIGKALLAHMDEDRLDRLLARTDLQAFTEHSITDRSALKEDLKTIRARGFSVDNEEKNLGMRCIAAPVFDMNKEAVAGISVSGPTHRVDEAEIERLSSAVIGAAHQLTLAIGGGATEPRS

SEQ ID NO: 628 - protein, 244 aa, Oceanicola flagellatus CGMCC 1.12644
MEVFEFLSEAQGKTLSALAGDLEQSPATVYRILVTLEVRGLVEFDQADQVWHIGPRAFLIGARFLKRTSLVDRARPLLRQLMEATGETANLGIEQNGNVLFVSQVETNASIRAFFPPGTLSRLHASGIGKALLSQMDDHRINRFLDRGPLEKFTEYTLTERSALIADLATTRARGYAIDGEERNLGMRCIAAPVFDIHDEAIAGISVSGPTTRVTPEEIERLSVAVLTASHKLTAAIGGATPDH

SEQ ID NO: 629 - protein, 269 aa, Phaeobacter inhibens S4Sm
MPQEKRKRGRPKSFKDNPEQNTNQSVDRAFDILEILATTPGLSMTDIADRVRMSPATAYRILNTLQKRRLTDLDPENQTWHVGSELFRLGSAFLNRSSLVERARPVMRNLMEVTGETANIGIEREGEILFLSQVETHANIRAFFQPGARAPLHASGIGKALLSRFDRARVDKLIPQDRLEQFTMKTIFDKTRLFEELDHINRQGWALDDEERTQGMRCIASPVIDHLGEAIGGISVSGPSARMPDEKLVAMGNAVRKAASDLSNRLGAP

SEQ ID NO: 630 - protein, 283 aa, Brevirhabdus pacifica DSM 27767
MANEHTRDAARPRGRPKAFNDATPQNTIKSLDRALHVLAELARMENATLTGLAQELSESPATVYRVLTTFQGHGIVDIDEAAQTWHVGPNAFLIGSGFLRRTSLIERSRPVLRKLMEATGETANLGIENDGEVLFVSQVETHASIRAFFPPGTKSPAHASGIGKALLAHFPKDRLDRVLSRELQGFTPHTLTRPEALLSDLEAIRARGYSVDNEERNEGMRCIAAPIRNTYGETIAGISVSGPTSRVGPDQVEALALSVREAAEEVSASLGAKASLPTAGKAG

SEQ ID NO: 631 - protein, 282 aa, Methylobacterium radiotolerans SB3
MDTGNRRRGRPKGFGGAKPTATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGRTFARFTDKTIGSLDQLRDDVEATRRRGYAIDDEERSIGMRCVAAPILNVHGEAIAGISVSGPTHRLSDEKLRAIGERVRRGAAAVSRALGAPAATTEAPDEPDRD

SEQ ID NO: 632 - protein, 280 aa, Pelagimonas varians DSM 23678
MDSQDNAASPAKRARGRPRDWDDKTAQNTIKSLDRAMEVFEYLSEGRGKALTAISSEMGQSPATVYRILVTLEGRGLVEFDRFEQVWNIGPRAFVIGARFLRRTSLVDRARPIMRKLMEATGETANLGIEKEGAVLFLSQVETHASIRAFFPPGTLSPMHASGIGKALLAQMDEARLGRTLAGQTLDAFTPYTITDPAELRVGLEAVRAQGYALDGEEKTLGMRCIAAPVFDVNQEAVAGISVSGPISRVGPEDIDRLSAFVIKAARDLSSAIGGEMAQR

SEQ ID NO: 633 - protein, 278 aa, Thalassobius mediterraneus 5120
MSDEIRRKGRPKAFSADPKASTIQALDRAFDVLDVIAAHSGLTLSEIATALDQSPATMHRVLATLEARQVVETDPVRQTWHIGAAAFRLGSAFLRRSSVVERARPVMRALMEETGETSNLGIERNSEVMFLSQVETHESIRAFFPPGTLSPMHASGIGKALLAAMPEDAVSKRLRHLTLERFTDKTILTTAELQADLVQIQRRGWAFDDEEKALGMRCVAAPIRNLHGEPVAGLSISGPVQRLPLDRIEHIGARVRAAAQQLSQDLGAPDGPNGSPTG

SEQ ID NO: 634 - protein, 261 aa, Thalassobius mediterraneus 5120
MAERQTNGVQSVQRALALLERVAEAQCGARLTDLARDAGLAASTVHRLLTTLEQSGFVHADAASGRWHVGQRAFAVGAAYTKQRSFVAPALPFLKRLRDTTRETANLGVIEDGEVVTLSQVESREIMRAISPPGGRVPVMCSGMGKAILATWEDAAIDRAIERHGLRALTKRSLTSPKAVHAEIANIRQRGYALDDEEFVIGLRCVAAVVWGPAGEPACAISVSGLAARMTPEKVTQTGATVQRLAAELTEVLGGKPPESS

SEQ ID NO: 635 - protein, 284 aa, Jannaschia sp. CCS1
MSMASSSTPPASGPSRRARGRPRGWDDKTAQNTIKSLDRAMEVFEHLSATRGATLSVLAKDLDQSPATVYRILVTLEGRGLVEFDPTAQHWHIGARAFVIGARYLRRTSLVDRARPVMRRLMEITGETANLGVARDTHVLFVSQVETHASIRAFFPPGTLSPMHASGIGKALLAQMSDDRLSRLIATAPLDQFTSRTLTEPATLRADLEATRERGYSIDDEEKNEGMRCIAAPVLDFSGEAVAGISVSGPVSRISVAQTEEIAQAVMAAAAELSTAMGAERPRS

SEQ ID NO: 636 - protein, 269 aa, Mesorhizobium sp. BNC1
MQLPVRRRGRPKSGRNEPPGSNIQALDRALDVVEALASHDGMTLTELSDHLRQSAATMYRVLSTLERRQYVEINPERQEWFIGPEAFRLGSAFLRRTNIVESSRSIMRDLMARTGETSNLGIERDGDVLFVSQVETHETIRAFFPPGTRSPLHASGIGKALLSAFDDERLEAFINRARFIRFTDKTVANADQLREAVRQTRGQGYSLDDEERTIGMRCVAAAIFNSYGEAVAGISVSGPTIRLPDSKVREIGQWVVEAANEISRRLGAR

SEQ ID NO: 637 - protein, 280 aa, Roseovarius sp. TM1035
MTQTKRARGRPKSQFADSSAGTMQALDRALSVLTAVARQEGVNLTDLSLSLGIPTATTHRILTTLQKRDFVRFDEERQDWTIGIEAYRTGVAYLKRTNLADAGRPVMRRLMEQTGETANLAVPDGAEVVFIGQVETQNPIRAFFPPGSRTPMHASGTGKAILAALPEDRLMALLKGAGLKGFTEETLITPRALFDDLAETRTRGWSFDRNERYDGMSCIGAAIFNDRGEPCAGVSISGPSSRFRDAQISEFGAAVAQAAVQITHLIAGKGVLISETTGSR

SEQ ID NO: 638 - protein, 282 aa, Methylobacterium radiotolerans JCM 2831 plasmid pMRAD01
MDTGNRRRGRPKGFGGAKPTATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGRTFARFTDKTIGSLDQLRDDVEATRRRGYAIDDEERSIGMRCVAAPILNVHGEAIAGISVSGPTHRLSDEKLRAIGERVRRGAAAVSRALGAPAATTEAPDEPGRD

SEQ ID NO: 639 - protein, 308 aa, Rhizobium sp. NGR234 plasmid pNGR234b
MEIREGAIRRGTGQSRVSPLLASERVVTGYLAVAVVSEQTKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPFLKRLMEESGETANIGIEDDGDVVFISQVESHAPMRAFFRPGRRGPSHASGIGKAILSTWSDTEIAKTLGGKTLMHFTGRTLDTVPALIRNIQEIRNRGWSIDDEEHTLGMRCIAAPLFNEYGEAIGGISISGPSVRIDDDRLETLGSLVRRTADELTRAIGGHRPGDG

SEQ ID NO: 640 - protein, 269 aa, Rhizobium sp. NGR234 plasmid pNGR234b
MQVANRRRGRPKSFNGPQSQSVIQSLDRALDVLEALALPEGMTLSELAAHLGQSPATMHRVLSTLERRELVEISPDRQVWHIGPEAYRLGSAFLRRTNIIERSRPIMRDLMLETGETSNLGIEKDGNVLFVSQVETHESIRAFFPPGTLSPLHASGIGKALLSTYDDNRLVSLFKKTTLERFTENTVRSLAQLEDELRVTRDRGYALDDEERTKGMRCVAAPILNVHGEAVAGISVSGPTHRMPDRQVHQIGERVRDAAKMVSRRLGAP

SEQ ID NO: 641 - protein, 292 aa, Citreicella sp. SE45 genomic scaffold scf_1113211290443
MNVAFKKNERDFMDSPKDAETSPRRARGRPRGWEDNSAQNTIKSLDRAVEVLEYLSSRPGLTLSELAGDLDQSPATVYRILVTLEGRRLVEFDPTEQLWHIGPQAFVIGARFLRRTSLVERARPILRGLMEETGETANLGIVREASVLFVSQVETHESIRAFFPPGTLSPLHASGIGKALLAEMPGERLEKLRVRPMERFTPHTLASPEALLNDLAAIRERGYSIDAEERNLGMRCIAAAVFDASGEAVAGISVSGPTIRMGEESTHEASRAVMRAARELTAAIGGVRPPVR

SEQ ID NO: 642 - protein, 277 aa, pCaer_C109
MPPSPRRKGRPKSFDSASQPPTIQSLDRALDVLDALAGASGMTLTELSTALDQSAATMYRVLATLEARQIVEMEPQSQTWHIGAMAFRLGSAFLRRSSVIERARPVMRELMEATGETSNLGIERGGDVMFVSQVETHESIRAFFPPGTTSPMHASGIGKALLSCFGEDQLTRFLRGRTLEQFTDKTLTSADTLREDLAQIRSRGWSFDDEEKAPGMRCVAAPVFGMQGEVLAGISVSGPAARMPDARINDIGALVRGAAEKLSYGLGAPPAEQSPPG

SEQ ID NO: 643 - protein, 269 aa, Ensifer fredii USDA257
MQVVKRRRGRPKAFNAPESPSVIQSLDRALDVLEALASPEGLTLSELAAHLGQSAATMHRVLSTLERREFVEISPDRQVWHIGPEAYRLGSAFLRRTNVVERSRPIMRELMLETGETSNLGIEKDGHVLFISQVETHESIRAFFPPGTLSPLHASGIGKALLSTYDDSRRTSLFKKSTLERFTENTVRSIAQLEEELRVTRDRGYAFDDEERTKGMRCVAAPILNVHGEAVAGISVSGPTHRMPDRQVQKIGERVRNAATKVSRRLGAP

SEQ ID NO: 644 - protein, 276 aa, Ensifer fredii USDA257
MAVVSEQTKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPFLKRLMDETGETANIGIEDDGDVVFISQVESHAPMRAFFRPGRRGPSHASGIGKAILSTWSDTEIAKTLGGKTLTHFTDRTIDTLPGLIRNIQDIRNRGWSIDDEEHTLGMRCIAAPLFNEYGEAIGGISISGPSVRIDDNRLEALGSLVRRTADELTRAIGGHRPGES

SEQ ID NO: 645 - protein, 279 aa, Paracoccus pantotrophus J46 ICCP
MSVQIRKRGRPRGRAGGLGAEDSGGIRALDRALDILDLIAVSSGLTLTEIAQRLDMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPADLKRMIREMRLERFTEMTLTDPQALLDDLACIRARGYALDNEERTPGMRCIAAPIFDLAGEAAAGISVSGPSLRMSDARLEAMSEAVIEAARELSLGMAPASRAGESG

SEQ ID NO: 646 - protein, 276 aa, Paracoccus sp. J4
MSVQIRKRGRPRGRAGGFGAEDSGGIRALDRALDILDLIAMSNGLTLTEIAQRLEMAPSTVHRVLVTLAARGVAESDSQTQAWHVGPTAFRHGSAFMRRSGLVERARPLLRRLMEVTGETANLGILNGEAVLFLSQAETHETIRAFFPPGTRSALHASGIGKALLAHARPADLKRMIREMALERFTPMTLSDPQALLDDLARIRARGYALDNEERTPGMRCIAAPIFDFAGEAAAGISVSGPTLRMSDARLEAMAEAVIAAARELSFGMAPPAAEG

SEQ ID NO: 647 - protein, 279 aa, Paracoccus sp. N5
MSAELRKRGRPRGRTAGAGAEDSGGIRALDRALDILDLIASSSGLTLSEIGQRLDMAPSTVHRVLVTLAARGVAETDPATQAWHVGPTAFRHGSAFMRRSGLVERARPLLRRLMEQTGETANLGILNGDAVLFLSQAETHETIRAFFPPGTRSALHASGIGKALLAHVRPAQLRLMLQGMALQRFTDKTLTEAQALEQDLARIRARGYSLDNEERTPGMRCIAAPIFDLSGEAAAGISVSGPTLRMSDARLEAMSEAVIAAARELSFGMTPARGTGGES

SEQ ID NO: 648 - protein, 280 aa, Roseovarius mucosus DSM 17069
MTQTKRARGRPKSQFADSSAGTMQALDRALSVLTAVARQEGVNLTDLSLSLGIPTATTHRILTTLQKRDFVRFDEERQDWTIGIEAYRTGVAYLKRTNLADAGRPVMRRLMEQTGETANLAVPDGAEVVFIGQVETQNPIRAFFPPGSRTPMHASGTGKAILAALPEDRLMALLKGAGLKGFTEETLITPRALFDDLAETRARGWSFDRNERYDGMSCIGAAIFNDRGEPCAGVSISGPSSRFHDAQISEFGAAVAQAAAQITHLIAGKVVAISETAGSR

SEQ ID NO: 649 - protein, 269 aa, Ensifer sp. USDA 6670
MQVVKRRRGRPKAFNAPESPSVIQSLDRALDVLEALASPEGLTLSELAAHLGQSAATMHRVLSTLERREFVEISPDRQVWHIGPEAYRLGSAFLRRTNVVERSRPIMRELMLETGETSNLGIEKDGHVLFISQVETHESIRAFFPPGTLSPLHASGIGKALLSTYDDSRLTSLFKKSTLESFTENTVRSIAQLEEELRVTRDRGYAFDDEERTRGMRCVAAPILNVHGEAVAGISVSGPTHRMPDRQVQKLGERVRNAAMKVSRRLGAP

SEQ ID NO: 650 - protein, 273 aa, Ensifer sp. USDA 6670
MEANGKGKRGRKAGENAAPASVQVLDRSLSLLAIIAEGDGSTLTALSERSGMAPSTVHRLLTSLAQHGMVANDAEAGTWTVGVKAFEIGNAFLRFRKLGTISRPFLKRLMDESGETANIGVEEDGDVVFISQVESHAPMRAFFRPGRRGPIHASGIGKAILSTWSDTEIAKTLSGRTLACFTGRTLATLPDLIRNVQEIRFRGWSVDDEEHTLGMRCIAAPLFNEYGEAIGGISISGPTVRIDNERLGVLGPAVRRTADELTRAIGGHRPEEG

SEQ ID NO: 651 - protein, 269 aa, Rhizobium etli CNPAF512
MTVPVRRRGRPKGFNDPQTQNVVQSLDRALDVLEALASPEGMTLSELAKHLGQSAATMHRVLATLERRDYVEMSPDGQIFHIGPEAYRLGAAFLRRTNVIERSRPVMRELMLETGETSNLGIEKNGKVLFVSQVETHESIRAFFPPGTLSPLHASGIGKALLSTYDEERFGALFKGTTLQRFTANTLRTVDQLREELEITRQRGYAFDDEEKAAGMRCVAAPVLNVHGEAVAGISVSGPAHRMPDRQVKRIGQRVIEAARLVSNRLGAS

SEQ ID NO: 652 - protein, 275 aa, Sulfitobacter sp. 20_GPM-1509m
MVSQDNPPSEPRRARGRPRDWSDKTAQNTIKSLDRAMEVFEFLSEHQGKALTTLASETDQSPATVYRILVTLEGRGLVEFDAVEQLWHIGPRAFVIGARFLRRTSLVERARPVMRRLMEQTGETANLGIERGGQVLFVSQVETEATIRAFFPPGTLSPMHASGIGKALLAEMDDARLQRALAGKELTAFTPYSITHLDALRADLEQVRARGYAVDAEERNIGMRCIAAPVFDIHQEAVAGISVSGPTSRVGLEDIERLSEAVRAAARDLTATLGG

SEQ ID NO: 653 - protein, 280 aa, Maribius sp. MOLA 401
MAGNDAVSGRRSRGRPRSWDDKSAQNVIKSLDRAMEVFAYLGQSGGVTLTELAHDLDQAPATIYRILVTLERHDLVEFDAQDQDWHIGSNAFLIGSRFLRRTSLVDRARPIMRTLMERTGETANLGVERAGQVLFVSQVETHANIRAFFPPGTLSRFHASGIGKVLLAWMPEDRRRALIEGAPLERFTPHTIVRTDMLIRDLQAARERGYAIDAEERTLGMRCIAAPVFDVHGEVRAGLSVSGPTSRIDAAAIAGLGRAVTDAAAALTAALGGASIPPPP

SEQ ID NO: 654 - protein, 275 aa, Rhodobacteraceae sp. HL-91
MTQLSRRGRPRAFHDKTAQNTIQSLDRAMAILETLAQSEGMTLSTLASACGQSTATVYRVLITLQQREMVDLDPAGQVWHVGVGTFRAGTSFLRRTSLVERARAPMQALMRDSGETANLGVEQQDEVLFLTQVETHQAIRAFFPPGTIGPMHVSGIGKALLAWFDDARVAQVVARRGLQAFTPASLTSLDALQADCARTRARGFAFDDEERAPGMRCIAAPIFNPHGEPVAGVSVSGPAFRLEAGNLDRIGALVVETAARITAATGGVAPAAKAV

SEQ ID NO: 655 - protein, 286 aa, Methylobacterium sp. UNCCL143
MDSGNRRRGRPKGFGGAKPAATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGKTFARFTDKTIGSLDQLRDDVEATRRRGYAIDDEERSIGMRCVAAPILNVHGEAIAGISVSGPTHRLSDEKLRAIGERVRRGAAAVSRALGAPAATMTATPDAPGEPDQD

SEQ ID NO: 656 - protein, 280 aa, Aquisalimonas asiatica CGMCC 1.6291
MADDRERRRKRGRPRSDRPQDATGTVQALDRGLRLLALLAEQDEMTLTEIGLDAGIAPTTAYRLLVTLQQRDMVTFDEEAQTWSIGVETFRIGSAFLRRTNYLEAGRPVMRRLMEASGETSNMAIQDGSDVVFVSQIETHKPIRAFFRPGTRGHMHASGIGKALLAERSEQDVRAIITEKGLPAFTDTTLTTADALFADLARTRERGWAVDDEESTTGMRCLAAPVFNEYGEAIAGISISGLAVRLPDTVLDTLGPLVRDAADEVTDNIGGLLPARMATD

SEQ ID NO: 657 - protein, 275 aa, Roseovarius lutimaris DSM 28463
MTPPKRARGRPKSQFGESSAGTMQSLDRALSVLVAVAREDRATLTDLSLALGIPTATTHRILTTLQKRDFVRFDDERQDWSIGIEAYRTGVAFLKRTNLSDVGRPVMRRLMEQTGETANLAVRDGAEVVFIGQVETQNPIRAFFPPGSRTPMHASGTGKAIMAALPKDRLLSLLKGAGLKGFTEQTHVTPKALFDDLAKTRARGWSFDRNERYDGMSCIGSAIFNDRGEPCAGVSISGPSSRFSDAQIAEFGAAVAQAAAEITHLIAGQSVDTTG

SEQ ID NO: 658 - protein, 265 aa, Roseovarius lutimaris DSM 28463
MERYTEVTTPKTEGVQSVVRALRLLKLLSLNDEGLRVSDIARQAGLAVSTTHRLLTTLERQNFAQFEPDRALWHVGREAFAVGAAFGRRHNFVAPALPYLRRLRDLTRETANLGILDQDELVTISQVESREIMRAISPPGGRVPTFCSGMGKAILATWEDADIAAFVARTGFHPMTKRSHRDMTTAMVDIKRIRSRGYALDDEEHVTGLRCLAAVVWSAQGEAVCAISVSGLAARLPDARLDAIGKQVAEAARELTQKLGGAPPG

SEQ ID NO: 659 - protein, 277 aa, Halocynthiibacter sp. PAMC 20958
MKTQDDKNQGPRKPRGRPRDWHDKTAQNTIKSLDRAMEVFEFLSDTQGKALTTLASDLNQSPSTVYRILVTLEARGLVEFDQVDQVWHIGARAFVIGSRFLRRTSLVERARPHLRALMEKTGETANLGIRQHGRVLFVSQVETDATIRAFFPPGTLSRLHASGIGKALLAEMDPDRIEKLISDEPLERFTEFTLTDRDALKEDLRITRERGYSLDGEERNLGMRCIAAPVFDIHGEALAGISVSGPTSRVGVEQIPELSEAVLVAARDLSASIGGKS

SEQ ID NO: 660 - protein, 271 aa, Leisingera sp. ANG-S3; identical to SEQ ID NO: 624

SEQ ID NO: 661 - protein, 267 aa, Paracoccus saliphilus DSM 18447
MAEPTRKRGRPRKDAPETSGTIQALDRALDMLDLLAAHPGLTLSEVAEQMKQSPSTVHRVLHTLAARGVAESDPATQTWHIGPATFRLGSAFMRRSGIVERARPILRTLMEHTGETANLGILNGDAVLFVSQAETHETIRAFFPPGTRSPLHASGIGKALLAFGRPEILRMLLDKAELPRFTDKTLTTAEALQEDTIRIRARGFSFDDEERTRGMRCIAAPVFDLTGEAVAGLSVSGPTHRIGHEHVKTLGAAVAASAQELTQALGG

SEQ ID NO: 662 - protein, 275 aa, Rhodovulum sulfidophilum DSM 1374
MTQPRPRGRPRAFHDKTDQNTVRALDRAMGLLTALSETKGLTLSELAALSNQSPATVYRVLITLQGHDIVELEEEAQRWHVGPGAFRIGSGFLRRTNVAERSRGAMQALMRATGETANLGVEDRDEVLFLTQVETHETIRAFFSPGTRGPMHCSGIGKALLAFLPAARVAAILKTQGLPGFTPRSITSETGLHADLDRTRARGYAIDDQERAEGMRCIAAPIFNAHGEPIAGLSVSGPAFRIPLDAADGIGAEVRAAADRVTAATGGISPTEKSA

SEQ ID NO: 663 - protein, 282 aa, Litoreibacter ascidiaceicola DSM 100566
MDSKNNAGISHRKARGRPRDWDDKSAQNTIKSLDRAMEVFEFLSEAQGKTLTMLATDLSQSPATVYRILVTLEGRGLVEFDQDDQVWHIGPRAFVIGARFLRRTSLVERARPVLRSLMEDTGETANLGIEQNGHVLFVSQVETTASIRAFFPPGTLSRMHASGIGKALLAEMEEQRIRKLLSKAPLEGFTEFTLTDHTALLEDLHLSKARGYAIDGEERNLGMRCIAAPVFDIHGEAIAGISVSGPTTRVGAEQVAALSEAVVAAASRLTVAIGGAPPPAQG

SEQ ID NO: 664 - protein, 275 aa, Roseovarius marisflavi DSM 29327
VTPPKRGRGRPKSQFSESSAGTMQSLDRALSVLVAVAREDRATLTDLSLALGIPTATTHRILTTLQKRDFVRFDDERQDWSIGIEAYRTGVAFLKRTNLSDVGRPVMRRLMEQTGETANLAVRDGAEVVFIGQVETQNPIRAFFPPGSRTPMHASGTGKAILAALPEDRLLTVLKGAGLKEFTEHTHVTPKALFADLEKTRARGWSFDRNERYDGMSCIGSAIFNDRGEPCAGVSISGPSSRFSDAQIAEFGAAVAQAAAEITHLIAGQLVEVKA

SEQ ID NO: 665 - protein, 265 aa, Roseovarius marisflavi DSM 29327
MERYTEVINPKTEGVQSVARALRLLKILSQNDEGLRVSDIARQAGLAVSTTHRLLTTLELQNFSQFEPDRALWHVGREAFAVGSAFGRRHNFVAPALPYLRRLRDLTRETANLGILDHDELVTISQVESREIMRAISPPGGRVPTFCSGMGKAILATWQDADIAAFVARTGFHPMTKRSHRNLTTAMVDIKRIRAQGYALDDEEHVTGLRCLAAVVWSAQGEAACAISVSGLAARLPESRLDAIGKQVADAARELTQKLGGTPPA

SEQ ID NO: 666 - protein, 273 aa, Rhodovulum sp. ES.010
MTQARPRGRPRAFHDKTEQNTIQSLDRAMALLRALAKTNGLTLTELADRSGQSAATVYRVLVTLQGHEIVEFEEGAQRWHVGAGAFRIGSGFLRRANVAERSRGAMQALMRATGETANLGVENRDEVLFLTQVETHEAIRAFFPPGTRSPMHVSGIGKALLAYYPEARVAGIVAEKGLAGFTSLSITSEASLSRDLARTRERGFAIDDQERAEGMRCVAAPIFNAHGEPVAGLSVSGPAFRMTLSEAARMGQEVRKAADSVTAAIGGTPHGQA

SEQ ID NO: 667 - protein, 279 aa, Ruegeria sp. P4
MDSQENAPKATRRARGRPRDWHDKTAQNTIKSLDRAMEVFEFLSEAQGKPLTMIAEEMGQSPATVYRILVTLEGRGLVEFDTEEQLWHIGARAFVIGARFLRRTSLVDRARPILRKLMEETGETANLGIEKEGHVLFLSQVETHASIRAFFPPGTLSQMHASGIGKALLAQMESSRLDRLLATTRLEVFTDHTITDHEALKQDLTAIRAQGFAVDNEEKNAGMRCIAAPVFDMNREAIAGISVSGPTSRISAQEITQLSRPVIEAARALTLAIGGDVAS

SEQ ID NO: 668 - protein, 274 aa, Jannaschia rubra CECT 5088
MDFQDNPVRRARGRPRAFDARTEQNTIKSLDRALMVLDELSHMESASLSELAQGLEESPATVYRILSTFALHGVVEVDAAQQTWHIGADAFRIGSAFLRRTSLVERSRAVLRGLMKTTGETANLGVEKDGAVLFVSQVETHAPIRAFFPPGTLSPLHASGIGKVLLAHAPAGRLEQVAAKGLESFTPHTLADLGRLRADLDLIRARGHAVDDQERNLGMRCIAAPIRNVHGEVVAGISVSGPTSRVSPDHVPDLARAVIAAAAEVSAAIGAPGG

SEQ ID NO: 669 - protein, 277 aa, Ruegeria atlantica CECT 4292
MNETKKPLRRGRPRLKANEEKAEVSLVVALDRGIQVLIFLADRRCATLAELAKVTAIPAATAHRLLTTLQQRGMVVHDAEKGKWRIGPQSYRIGSTFEEGSNLLEVAPAEMRILSEETGETANLAIEEGGLLLFLVQVESENPIRASFKNGTAAHFHTSGVGKAIMAFMDEAALESFLTPQILVQQTPNSITDVQELKAELCKSRERGWALDDEERFLGMRCIAAPIFDSLGKVVAGVSVSGPITRFPDHKLEDLAKLVVKAATTISDKLTQSSAGS

SEQ ID NO: 670 - protein, 273 aa, Ruegeria atlantica CECT 4292
MDSQKRPRGRPKSLFKESSAGTMQSLDRALGVLTTVARLERAALSDLAREIDVPTATTHRILVTLQKHGFVAFDDERQEWMIGIEAYRTGASFLRRNSVLEIGRPILRRLMQDSGETANLAVPDGSEVVFVGQVETPNPIRAFFPPGARTPMYASGIGKAILAAMSEPGLAKTLGAIAPVEFTANTQIPGDGLQQDLAKTRARGWSHDREERYQGMSCIGSAIFNDRGEPCAGISVSGPTARFGADRAHALGELVLAAAREITHLSGGQTPKT

SEQ ID NO: 671 - protein, 269 aa, Rhizobium sp. N324
MQNLNRRRGRPKSFNEPQSSSVIQSLDRALDVLEALASPEGMTLSELSAHLDQSPATMHRVLATLERREFVEISPDRQVWFIGPEAYRTGAAFLRRSNVVERSRPIMRELMLETGETSNLGIEKDGNILFISQVETHESIRAFFPPGTLSPLHASGIGKALLSTYDDGRLSALFKTSTLKRFTENTARSVAQLKEELIVSRERGYAIDDEERTKGMRCVAAPILNVHGEAVAGISVSGPTHRMPDRLIRQIGERVAGAAKTVSRRLGGG

SEQ ID NO: 672 - protein, 269 aa, Rhizobium sp. N941; identical to SEQ ID NO: 671

SEQ ID NO: 673 - protein, 269 aa, Sinorhizobium americanum CFNEI 73
MQVVKRRRGRPKAFNAPESPNIIQSLDRALDVLEALASPEGLTLSELAAHLGQSAATMHRVLSTLERREFVEISPDRQVWHIGPEAYRLGSAFLRRTNVVERSRPIMRELMLETGETSNLGVEKDGNVLFISQVETHESIRAFFPPGTLSPLHASGIGKALLSTYDDSRLASLFKKTTLERFTANTVRSVAQLEEELRVTRDRGYALDDEERTKGMRCVAAPILNVHGEAVAGISVSGPTHRMPDRQVQQIGERVRNAAKMVSRRLGAP

SEQ ID NO: 674 - protein, 276 aa, Sinorhizobium americanum CFNEI 73
VAVVSEQAKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPYLKRLMDESGETANIGIEDDGDVVFISQVESHAPMRAFFRPGRRGPSHASGIGKAILSTWSDTEIAKTLGGRTLTHFTDRTLDTLPALIRNIQEIRNRGWSIDDEEHTLGMRCIAAPLFNEYGEAIGGISISGPSVRIDDNRLEPLGSLVRRTADELTRAIGGHRPGEG

SEQ ID NO: 675 - protein, 278 aa, Puniceibacterium sediminis DSM 29052
VTGDSEEDFTARGRGRPRSWHDKSEQNTIKSLDRAMEVLERLSEMKGATLSQISGDLGQSPASVYRVLFTLEARGIVDFDSGPQTWHIGAGAFLIGSRFLRRTSLLERALPVLRSLMDATGETANLGIEQSGQVLFLSQVETMATIRAFFPPGTMSPMHASGIGKALLAQRGAGQVARILDAHGLERFTEFTHVTRDALLADLAETRARGYSIDGEEKNIGMRCVAAPIFDVHGVAVAGISVSGPSSRVVPDAIPGLGAQVIAAAAEITHGIGGRVSG

SEQ ID NO: 676 - protein, 269 aa, Hyphomicrobium sulfonivorans WDL6
MLHHGRRRGRPRATKADPAASNIKSLNRALDVLEALAAHEGVTLSGLSSHLHESTATMHRVLSTLERREYVECDPERQEWFIGPAAFKLGSAFLGRTNLVERSRLVMRDLVTISGETSNLGIHRDGQVLFVSQVETQETIRAFLPPGTSAPLHASGIGKALLSSFDDDRLEAFISTAKFTRFTDRTISSANQLRKAIKLTRQCGYALDDEERTIGMRCVAATILDVHGEAVAGISISGPTIRMPDKKVRQIGKWVMEAANEISRRVGAG

SEQ ID NO: 677 - protein, 275 aa, Marivita geojedonensis DSM 29432
MNAETGPERRARGRPRAWGDTTEQNKIKSLDRALVILERLSEWGGATLTDLSEDLKQSPATVYRVLYTFEARGMVDFDPVAQTWHIGAGAFHIGSRFLRRTSLVERARPFLRELMRKTEETANLGISRDGMVLFLSQVETHHNIRAFFPPGTMSPMHSSGIGKALLAQMDDKEVAAIIRKHKLTAFTEHTLVTPEALMSDLEATRKRGYAFDAEEKNDGMRCIAAPVFDMHGEPIAGVSISGPSARIPDERIESLGADVRDTAAKLTAALGGPSD

SEQ ID NO: 678 - protein, 286 aa, Stappia aggregata IAM 12614
MIDPKPDSSATRRARGRPRAWDDKTEQNTIKSLDRAMAVFEHLSTQSGVSLSALSDQLGESTATLYRILFTLETRGLVEFDQAQQLWHIGPGAFIIGARFLRRTSLVERARPILRSLMEQTGETANLGVAQADQVLFVSQVETHESIRAFFPPGTLSPLHASGIGKALLAFMDEDQCKRILKQTDRERFTEHTLCDADLLAADLEAIRARGFSIDGEEKNLGMRCIAAPVFNHYGEAVAGLSVSGPTSRVSPDRIAPFADAVKTAAAALTAALGGENALPQTKTAE

SEQ ID NO: 679 - protein, 271 aa, Sagittula stellata E-37
MSPEKRPRGRPKSAFKESSAGGLQSLDRALMLLSAVARRQSATLSDLARETDIPTATTHRILSTLQAQRYVAFDEERQEWRVGIEAYRTGLSFLARTSVAEVGRPVMRRLMADTGETANLAVPDGAEVVFIGQVETPNPIRAFFPPGTRTSMHASGTGKAILAALRPDRLARVMGRIVFDAYTPGTLASEAALRADLSETARRGWSLDLEERHPGMSCIGAAIRDEQGDPCAGISVSGPTARFSPDRVPGLGRAVREAAREITELSGGRWA

SEQ ID NO: 680 - protein, 275 aa, Roseobacter sp. CCS2
MQDDVKRGRGRPKSWDNKAAQNTIKSLDRALEVLVQLGEMQGSTLSEIAVALDQSPATVYRVLTTFQGRGFADFDEQAQTWSIGPAAFLTGSHFLRRTSLVERARPIMRDLMEATGETANLGIERDGKVLFLGQVETHATIRAFFAPGTASSMHSSGIGKALLCRMDDKRQREVLAASQLEQYTPFTLTDPEAMIADLHATKARGYAIDGEERNIGMRCIAAPVYNVFGEAVAGISVSGPTSRITEDRIEELATPVMDAAARLTRAIGGNNRPAG

SEQ ID NO: 681 - protein, 282 aa, Roseobacter sp. AzwK-3b
MDQTTRRRGRPKGFNSPTSKTTIQSLDRAFDVLDCLAARDGLTLTDIAETLEQSPATIHRVLATLEARGIVDSDTGTQTWFIGAMAYRIGSAFLRRSGVVERARASMRELMQSTGETANLGIEQAGQVMFISQVETPQTIRAFFPPGTVSPMHASGIGKALLAQYADDRMAAFLKAHALTRFTDRTITDPDALREDMALTRARGWAWDDEEKAAGMRCVAAPIFNIFAEPVAGISVSGPTHRMDLARIEEIGAMVREAAAAVSRALGAETNKPSQVADQAAS

SEQ ID NO: 682 - protein, 281 aa, Rhodobacteraceae bacterium KLH11 scf_1108856220445 genomic scaffold
MDAQKRPRGRPKSLFKESSAGTMQSLDRALGVLTAVARLERSALSDLAREVEVPTATTHRILVTLQKHGFVIFDEERQEWMIGIEAYRTGASFLHRNNVLEIGRPILRRLMQDSGETANLAVPDGAEVVFVGQVETQNPIRAFFPPGARTPMYASGTGKAILAAMSDESLGKALGATKLIPFTENTCLPGSGLQRDLAKTRARGWSHDHEERYEGMSCIGAAIFNDRGEPCAGISVSGPTVRFCSTRAPELAELVLTAAREITHLSGGRAPELSARHPGNP

SEQ ID NO: 683 - protein, 279 aa, Silicibacter sp. TrichCH4B genomic scaffold scf_1113354613205
MDSQENAPKATRRARGRPRDWHDKTAQNTIKSLDRAMEVFEFLSEAQGKPLTMIAEEMGQSPATVYRILVTLEGRGLVEFDTEEQLWHIGARAFVIGARFLRRTSLVDRARPILRKLMEETGETANLGIEKEGHVLFLSQVETHASIRAFFPPGTLSQMHASGIGKALLAQMESSRLDRLLAATRLEVFTDHTITDHEALKQDLTAIRAQGFAVDNEEKNAGMRCIAAPVFDMNREAIAGISVSGPTSRISVQEITQLSRPVIEAAHALTLAIGGDVTP

SEQ ID NO: 684 - protein, 280 aa, Pelagibaca bermudensis HTCC2601 1100011001308
MDSQDNGSRSPRKARGRPRDWEDKTAQNTIKSLDRAMEVFEFLSERQGMALSTISDEMGQSPSTVYRVLVTLEGRGLVEFDAEEQLWHIGARAFTIGARFLRRTSLVDRARPVMRRLMEATGETANLGVEKEGQVLFLSQVETHANIRAFFPPGTLSAMHASGIGKALLAQMDEDRLSRRLEGGLQSFTPRTITDRIALQEDLARIRARGYSVDDEERNLGMRCIAAPVFDAAGEALAGISVSGPTSRVTADALDRLSRPVIEAARTLTEAIGGQVTRQP

SEQ ID NO: 685 - protein, 276 aa, Paracoccus sp. J39 ICCT; identical to SEQ ID NO: 646

SEQ ID NO: 686 - protein, 276 aa, Paracoccus sp. J55; identical to SEQ ID NO: 646

SEQ ID NO: 687 - protein, 272 aa, Rhodovibrio salinarum DSM 9154
MAQGGRRGRGRPRSASSDTAATTVQALDRGIQVLATLSQFGRATLTDLAVTAEMAPSTVHRLLETLRQHSIVEFDEVDQTWAVGVEAFRIGSTYLLRANYIDAGRQMMRRMVERTGETANLGVPDAGDVVFVSQVETQQPIRAFFPPGTRGHMHASGIGKALLAEMSSERVAAITRQRGLPAFTDNTITTLDRLNEDLAATRTRGWAIDDQERQLGMRCLAAPIFNEFREIVAGISISGPAVRLPDDKLAEFGPLVRESADEVTHRIGGARP

SEQ ID NO: 688 - protein, 287 aa, Rubellimicrobium mesophilum DSM 19309 (scaffold version)
MVAAKDLTGNLKNGAERRPRGRPRAFDDKTDQNVIKSLDRSLEVLGELARLEATTLSELARALDEAPATVYRILVTMQAHRMVEFDEAQQVWHVGAGAFLIGSAFLRRTGLIERARPVLRSLMEATGETANLGVESDGAVLFVSQVETHAAIRAFFPPGTKSPLHASGIGKVLLAHAAPDQVRRLLARPLQGYTDRTLTDSGELSAALAEVRARGYAVDNEERTEGMRCVAAGIRNAYGETVAGLSVSGPVSRVRPDAIPALAARVVEAAEAVSLALGARPVSPPAG

SEQ ID NO: 689 - protein, 283 aa, Maritimibacter sp. HL-12
MSDASTTNAPRRARGRPRGWNDKTGQNTIKSLDRAMEVFDHLSTTPGQTLSELAADLRQSPATVYRILITLERRRLVEFERAEQLWHIGPHAFVIGSRFLRRTSLVERARPILRRLMEDTGETANLGIVQGGSVLFVSQVETHANIRAFFPPGSLSPLHSSGIGKALLADMSEERLNRMISHGPLETFTPNTLATKSALVADLAMTRQRGYAIDNEEKNLGMRCIASSVFDMHEEAVAGISISGPSIRMEPDQIARLSRFVVDAAADLTAALGGTPRQEPPSA

SEQ ID NO: 690 - protein, 282 aa, Methylobacterium sp. L2-4; identical to SEQ ID NO: 631

SEQ ID NO: 691 - protein, 269 aa, Ensifer fredii GR64
MQPAKRRRGRPKGFNAPESQTVIQSLDRALDVLEAVAWPEGLTLSELAAHLGQSAATMHRVLATLERREFVEISPDRQVWHIGPEAYRLGSAFLRRTNVVERSRPIMRELMLETGETSNLGIEKDGNVLFISQVETHESIRAFFPPGTLSPLHASGIGKALLSTYDDSRLASLFKKATLERFTENTVRSFAQLEEELRATRDRGYAFDDEERTQGMRCVAAPILNVHGEAVAGISVSGPTHRMSDKRVQQIGERVRSAAKTVSRRLGAP

SEQ ID NO: 692 - protein, 282 aa, Ensifer fredii GR64
VTEYSAVTVVSEQTKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPFLKRLMEESGETANIGIEDDGDVVFISQVESHAPMRAFFRPGRRGPSHASGIGKAILSTWSDTDVAKTLGSKTLTHFTDRTLDTLPALIRNIQEIRNRGWSIDDEEHTLGMRCIAAPLFNEYGEAIGGISISGPSVRIDDDRLETLGSLVRRTADELTRAIGGHRPGES

SEQ ID NO: 693 - protein, 280 aa, Ponticoccus litoralis DSM 18986
MDSQDNGPRGSRKARGRPRDWADKTAQNTIKSLDRAMEVFEFLSERQGMALSTISDEMDQSPSTVYRVLVTLEGRGLVEFDAEEQLWHIGARAFTIGARFLRRTSLVDRARPVMRRLMEATGETANLGVEKEGQVLFLSQVETHANIRAFFPPGTLSAMHASGIGKALLAQMDEGRLMRRLDGGLEAFTPHTVTDRAALLEDLARIRARGYSIDDEERNLGMRCIAAPVFDAAGEALAGISVSGPTSRVTQDELNRLSRPVIEAARTLTEAIGGQVTPRP

SEQ ID NO: 694 - protein, 269 aa, Rhizobium sp. OK494
MPQKPRRRGRPKAFNGPQTQNTIQALDRALDVLDALATPEGKTLSELAGQLGQSAATMHRVLATLERREFVEISPDRQVWHIGPEAYRLGAAFLRRSNVVERSRPIMRELMLETGETSNLGIEKDGNVLFISQVETHESIRAFFPPGTLSPLHASGIGKALLSTYDEDRLSALFRKKEFERFTENTVRSFEQLREELQKTRERGYSFDDEERTKGMRCVAAPILNVHGEAVAGISVSGPIHRLPDADIHQLGERVRSAARMVSRRLGAP

SEQ ID NO: 695 - protein, 274 aa, Planktotalea frisia DSM 23709
MPKSIDSKTPRHRGRPRAFNEKTEQNTIKSLDRALGVLSQLAQIESATLSELASALKESPATLYRVLTTFALHGIVEMDEANQTWHIGPEAYQIGSTFLRRTSLIDVSRPVMRLLMEQTGETANLGIEKSGSVLFVSQVETNAPIRAFFAPGTLSAMHASGIGKALLAHMDEKRLKRFAALGLETFTPHTLSTPETLAADMILTRTRGYALDDQEKNLGMRCIAAPIHNAHGEVVAGVSVSGPTTRVSTDQIETLAAFVMRAAQDISFALGSTR

SEQ ID NO: 696 - protein, 279 aa, Paracoccus denitrificans DSM 415; identical to SEQ ID NO: 603

SEQ ID NO: 697 - protein, 281 aa, Paracoccus halophilus CGMCC 1.6117
MSSEPRKRGRPRGRASGSGDSGGVRALDRALDVLDAIAGASGLTLTEIAQRLALAPSTVHRVLVTLEGRGVAEIDEVTQTWHVGPTAFRHGSAFMRRTGLVERARPVLRRLMEATGETANLGILNGEAVLFLSQAETHETIRAFFPPGTRSPLHASGIGKALLAHKPRREVEMVLDEMVLERFTPMTLCDRQALLDDLGTIRLRGYSLDNEERTPGMRCIAAPIFDPVGEAAAGISVSGPVLRMTDARLPAISEAVLRAARELSFGTAAGGDHPVRESDHA

SEQ ID NO: 698 - protein, 274 aa, Roseovarius tolerans DSM 11457
MTQTKRPRGRPKSQFSESSAGTMQSLDRALGVLTTVARQEGVNLTDLSLSLGIPTATTHRILTTLQKREFVRFDEERQDWTIGIEAYRTGVAYLKRTNLSDAGRPVMRRLMEQTGETANLAVPDGAEVVFIGQVETGNPIRAFFPPGSRTPMHASGIGKALLAALSEERRLALLKGAGLQGFTANTHVTPRALFEDLEQTAARGWSFDRNERYDGMSCIGAAIFNDRGEPCAGVSISGPSSRFSDARLPEFGRAVAQAAAQITHLIAGHDAEGT

SEQ ID NO: 699 - protein, 279 aa, Jannaschia pohangensis DSM 19073
MNTPKPESARLRGRPKAFNDKTDQNTIKALDRAMHVLRSLSELENATLTTLAQTTGDPAASVYRILVTLQAHDIVELDTSDQTWHVGPGAFQIGSVFLRRTSLIERAREPMRDLMEATGETANLGIRSGGDVLFVSQIETHAPIRAFFPPGTRGDLHASGIGKVLLSAMEPERRAAILPSPLPRYTDATLSDPEALAADLTRIAARGYSVDDEEKNTGMRCIAAPVRNLHGEVVAGISVSGPTSRVAPDRVADFARQVIDAAETLSQRLGARPRAPRDD

SEQ ID NO: 700 - protein, 271 aa, Ruegeria sp. 6PALISEP08
VQNHKKPRGRPKSIFKESSAGTLQSLDRALETLTTVAALERCTLSDLSRETGVPTATTHRILTTLSNRGYVSFDEQRQEWMIGIEAYRTGTSYLKRNNVVEIGRPILRKLMRDSGETANMAMPDGKYVVFVNQIETSNPIRAFFPHGARAPMYASGTGKALLAEMTSNALDTFLSDITFEPYTDRTHRSETSLLEDVSLIRQRGWSFDDEERYAGMSCTGAAILNQFGIPCAGVSVSGPTARINKSNAAYFGEMVLEAAREITTAIGGQAR

SEQ ID NO: 701 - protein, 275 aa, Mesorhizobium sp. F7
MEITEKRRRGRPRAFNAPAEPNAVQSLDRALRILAIVADGDGLSLSEVAERSELATSTAYRMLTTLQNRGMVEFAEQEQLWSIGVEAYRIGSAFLRSRRLVDRARSAMQVLMEKTGETANLGVAEDDCVVFVSQVETHQAIRAFFRPGTRSPFHASGIGKAILAYLSPERVEAIVDKTGLEPFTERTLADRDGLHIDLGEIRKRGWSVDDEERYPGMRCVAAPIFNEFGEPIGGVSISGPTVRVTPERLAAIGPEVREAARQITAMIGGEMPKNG

SEQ ID NO: 702 - protein, 280 aa, Oceanicola nitratireducens CGMCC 1.7292
MDSPKSTESTPRRNRGRPRGWDDNSAQYTIKSLDRAMEVLEYLSRRSGLTLSDLAGDLQQSPATVYRILVTLEGRRMVEFDPAEQLWHIGPQAFVIGARFLRRTSLVERARPILRRLMEETGETANLGIVREDAVLFVSQVETHESIRAFFPPGTLSPLHASGIGKALLAEIPNERLEKLLSRRMERFTPHTLASPDALRSDLEVIRTRGYAVDAEEKNLGMRCIAAAVFDASGEAAAGVSVSGPLIRMSEESTDETSRAVMHAARELTAAIGGVIPPAR

SEQ ID NO: 703 - protein, 269 aa, Sinorhizobium fredii CCBAU 25509; identical to SEQ ID NO: 625

SEQ ID NO: 704 - protein, 282 aa, Sinorhizobium fredii CCBAU 25509; identical to SEQ ID NO: 626

SEQ ID NO: 705 - protein, 271 aa, Leisingera sp. ANG-M6; identical to SEQ ID NO: 624

SEQ ID NO: 706 - protein, 271 aa, Leisingera sp. ANG-M7
MSQPPRRKGRPKSFDSASQPTTIQSLDRALDVLDALAGASGMTLTELSSALDQSAATMYRVLSTLEARQIVEMEPQSQTWHIGAMAFRLGSAFLRRSSVIERARPVMRELMEATGETSNLGIERGGDVMFVSQVETHESIRAFFPPGTTSPMHASGIGKALLSCFGEDQLARFLRGRSLERFTEKTLTSADALREDLVQIRSRGWSFDDEEKAQGMRCVAAPVFGMQGEVLAGISISGPTARMPDGGIDGIGALVKDAAQKLSQGMGAPAV

SEQ ID NO: 707 - protein, 275 aa, Loktanella maricola DSM 29128
MTEDVKRGRGRPKAWDNKGAQNTVKSLDRALEVLVQLGEMQGGTLSEIAGALDQSPATIYRVLTTFQGRGFVDFDAQNQTWNIGPAAFLTGSHFLRRTSLVERARPIMRKLMEATGETANLGIERDGKVLFLGQVETHATIRAFFPPGTASSMHSSGIGKALLCRMDNKRQREILAASQLEQYTPFTLTDPDAMIADLHATKARGYAIDAEERNIGMRCIAAPVYNVFGEAVAGISVSGPTSRITEDRIAELATPVMEAAAQLTGAIGGNNRPAG

SEQ ID NO: 708 - protein, 278 aa, Loktanella sediminum DSM 28715
MEHQKEADSGLRRSRGRPRDWHDKTEQNTIKSLDRAMQVFEYLSQEQGKPLSLLAEETGQSPATLYRILVTLEGRGLVEFDAENQIWHIGSQAFVIGARFLRRTSLVERARPILRRLMEATGETANLGVEKGGMVLFLSQVETHENIRAFFPPGTLSPMHSSGIGKALLSQMSDDRFGQWLKDQQLEKFTDRTLANADNLRKDLKGIRQSGYSFDNEEKNVGMQCIAAPVFDMNGEVVAGLSISGPTSRMAMREIDDLGQAVIRSANELSNAIGGQVR

SEQ ID NO: 709 - protein, 282 aa, Tateyamaria sp. ANG-S1
MSGAQNTQENPRRARGRPRGWDDKTEQNTIKSLDRAMEIFEYLSADQGKTLSQLASELSQSPATVYRVLITLEARGLVEFDPEEQRWYVGARAFVIGARFLRRTSLVDRARPILRALMERTGETANLGIEKGGMVLFLNQVETHESIRAFFPPGTLSDMHASGIGKALLAFMDEDRFGQWLKGRSLETFTAHTLVAPDALVQELRRTRARGYAIDAEEKNLGMRCIAAPVFDMYGEAVAGISVSGPATRMGWDVTERISRSVVDAARDLTRAVGGSNRHDAG

SEQ ID NO: 710 - protein, 284 aa, Labrenzia alexandrii CECT 5112
MPERENDLIAGRKARGRPRAWDDKSGQNTIKSLDRAMAVFEHLSTQSGVSLSALSDQTGESTATLYRILFTLETRGLVEFDQAQQLWHIGPAAFIVGARFLRRTSLVERARPILRELMEETGETANLGIQKGDQVLFVSQVETHASIRAFFPPGSLSPLHASGIGKALLAFMPETQCEKILKSAKRERFTSYTLCDAGLLKADLAQAQTRGYSIDGEEKNLGMRCIAAPVFNHYGEIAAGLSISGPTSRLTEDKIQSLGSAVMNAAGTLTSALGGEPPIETSDQ

SEQ ID NO: 711 - protein, 282 aa, Roseovarius litoreus DSM 28249
MDQTTRRRGRPKGFNSPTSKTTIQSLDRAFDVLDCLAARDGLTLTDIAETLEQSPATIHRVLATLEARGIVDSDTGTQTWFIGAMAYRIGSAFLRRAGVVERARASMRELMQSTGETANLGIEQAGQVMFISQVETPQTIRAFFPPGTVSPMHASGIGKALLAQYSDDRMAAFLKAHALTRFTDRTITDPDALRQDMDLTRARGWAFDDEEKAAGMRCVAAPIFNIFAEPVAGISVSGPTHRMDLARIEEIGTMVREAAAAVSRALGAETGKPSQAADQAAS

SEQ ID NO: 712 - protein, 304 aa, Labrenzia sp. CP4
MLYFSYGELIFQNQKNELMTDLKSDSSATRRARGRPRAWDDKTEQNTIKSLDRAMAVFEHLSTQSGVSLSALSDQLGESTATLYRILFTLETRGLVEFDQAQQLWHIGPGAFIIGARFLRRTSLVERARPVLRSLMEQTGETANLGVAQADQVLFVSQVETHESIRAFFPPGTLSPLHASGIGKALLAFMDEDQCKRILKQTDRERFTEHTLCDAGLLAADLEAIRARGFSIDGEEKNLGMRCIAAPVFNHYGEAVAGLSVSGPTSRVSPDRIAPFAEAVKAAAAALTAALGGEIAPPQTKTVE

SEQ ID NO: 713 - protein, 269 aa, Rhizobium sp. N541; identical to SEQ ID NO: 671

SEQ ID NO: 714 - protein, 279 aa, Paracoccus sp. MKU1
MSVQIRKRGRPRGRAGGFGAEDSGGIRALDRALDILDLIAASSGLTLTEIAQRLEMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPADLKRMIREMRLERFTEMTLTDPQALLEDLARIRVRGYALDNEERTPGMRCIAAPIFDLGGEAAAGISVSGPTLRMSDARLAAMSEAVIEAARELSFGMAPRPGEGESA

SEQ ID NO: 715 - protein, 282 aa, Pseudoruegeria marinistellae SF-16
MESRENDQRPHRKARGRPRNWVDKTAQNTIKSLDRAMEVFEFLSEAQGMTLTAISDEMGQSPATVYRILVTLQGRGLVGFDAEEQLWHIGPQAFVIGARFLRRTSLVDRARPILRKLMEATGETANLGTEKEGAVLFLSQVETNASIRAFFPPGTLSPMHASGIGKALLAEMDSERLERTLGRAELTIFTDRTITERAALLEDLKQIRSRGFSIDDEEKNTGMRCIAAPVFDMNREAIAGISVSGPTSRVDGGQIERLSRPVMEAAQELTIAIGGPATRPPS

SEQ ID NO: 716 - protein, 273 aa, Ruegeria conchae DSM 29317
MESQKRPRGRPKSMFKESSAGTMQSLDRALGVLTTVAGLERVALSDLAREVDVPTATTHRILVTLQKHGFVSFDEERQEWMVGIEAYRTGASFLRRNNVLEIGRPILRRLMLDSGETANLAVPDGPEVVFVGQVETQNPIRAFFPPGARTPMYASGTGKAILAALSEESLNKVLARTDLIAFTENTNLPQAGLHDDLAETRRRGWSYDHEERYEGMSCIGAAIFNDRAEPCAGISVSGPTVRFSLDRAPELGMLVRNAAQEITHLSGGRSPSQ

SEQ ID NO: 717 - protein, 286 aa, Labrenzia sp. C1B10
MTDLKSDSSATRRARGRPRAWDDKTEQNTIKSLDRAMAVFEHLSTQSGVSLSALSDQLGESTATLYRILFTLETRGLVEFDQAQQLWHIGPGAFIIGARFLRRTSLVERARPVLRSLMEQTGETANLGVAQADQVLFVSQVETHESIRAFFPPGTLSPLHASGIGKALLAFMDEDQCKRILKQTDRERFTEHTLCDAGLLAADLEAIRARGFSIDGEEKNLGMRCIAAPVFNHHGEAVAGLSVSGPTSRVSPDRIAPFAEAVKAAAAALTAALGGEIAPPQTKTVG

SEQ ID NO: 718 - protein, 282 aa, Methylobacterium radiotolerans NDB3P7; identical to SEQ ID NO: 638

SEQ ID NO: 719 - protein, 280 aa, Roseovarius sp. 217
MTQTKRARGRPKSQFADSSAGTMQALDRALSVLTAVARQEGVNLTDLSLSLGIPTATTHRILTTLQKRDFVRFDEERQDWTIGIEAYRTGVAYLKRTNLADAGRPVMRRLMEQTGETANLAVPDGAEVVFIGQVETQNPIRAFFPPGSRTPMHASGTGKAILASLPEDRLMALLKGAGLKGFTEETLITPRALFDDLAETRRRGWSFDRNERYDGMSCIGAAIFNDRGEPCAGVSISGPSSRFGDAQIAEFGAAVAQAATQITHLIAGKGVVISETNGSR

SEQ ID NO: 720 - protein, 259 aa, Roseovarius sp. 217
MSDPQSQGVQSVARALRLLQLLSQQDEGARVSDLARLAGLAVSTTHRLLTTLELQHFAQFDSDRALWHVGRGAFSVGAAFSRRHNFVAPALPLLRRLRDATRETANLGILDQDELVTLSQVESREIMRAISPPGGRVPAFCSGMGKAILATWPNADIADFVARTGFHPMTKRSHRSLSTAMVDIKRIRAQGYALDDEEHVTGLRCLAAVVWSPQAEAVCAISVSGLAARLPDARLSAIGRQVAEAAADLTLKIGGQRPV

SEQ ID NO: 721 - protein, 269 aa, Rhizobium leguminosarum bv. trifolii WSM597
MTVPVRRRGRPKGFNDPQTQNVVQSLDRALDVLEALASPEGMTLSELAKHLAQSAATMHRVLATLERRDYVEMSPDGQIFHIGPEAYRLGAAFLRRTNVIERSRPVMRELMLETGETSNLGIEKNGKVLFVSQVETHESIRAFFPPGTLSPLHASGIGKALLSTYDEERLAALFKGATLQRFTANTLRTIEQLREELEITRQRGYAFDDEEKAAGMRCVAAPVLNVHGEAVAGISVSGPAHRMPDRQIKRIGQRVIEAARLVSNRLGAS

SEQ ID NO: 722 - protein, 277 aa, pMeth_A285
MPQPPRRKGRPKGFDSASQPTTIQALDRALDVLDALAGASGMTLTELSTGLGQSAATMYRVLATLEARQIVEIEPQSQTWHIGAMAFRLGSAFLRRSSVIERARPVMRELMEATGETSNLGIERNGDVMFVSQVETHESIRAFFPPGTISPMHASGIGKALLSCFGEDQLARFLRGRTLERFTAKTLISAKALRADLLQIRSRGWSFDDEEKAPGMRCVAAPVFGMQGEVLAGISISGPASRMPDAGINGIGALVKDAAEKLSYGLGAPAAVETQPG

SEQ ID NO: 723 - protein, 288 aa, Roseobacter litoralis Och 149
MNTQKRQRGRPKSQFKESSAGTMQSLDRALGVLVAVAKSEQSTLTDLSLSLGVPTATTHRILTTLQKHRFVIFNEEHQSWSIGIEAYRTGASFMNRTSLTEVSRPIMRFLMEKTGETANLAIPDGAEVVFVEQIETPHPIRAFFARGARTSMHASGIGKAILSTMSEDHVRRLLMSSGLQAFTDNTLTSPATLFADLAETKTRGYSYDREERYLGMSCIGSAVFDERGEACGGVSISGPSTRFDSMRVPELGAIVAEAAGQISQLIGGRRREPHADDIAPNPTADPAG

SEQ ID NO: 724 - protein, 288 aa, Octadecabacter antarcticus 307
MPDDPDTAPFHAQSRARGRPKAWVDKTEQNTIKSLDRALEVLSRLGDLEEATLSELASDLGQSPATIYRVLTTYRTHAFTDFDESRQVWSVGAGAFLTGAKFLRRTSMVERARPHLRRLMEATEETANLGVAKDADVLFLSQSETHHAIRAFFPPGTLSPMHASGIGKALLAQWPQKRVDAMLAARTPEQFTAFTLVTRDALMGDLRETQRRGYSFDGEEKNIGMRCIAAPVFDVYGDAVAGLSISGPVARITDEKIAEIGALVRAGADALTRELGGVSPHHPTRFEA

SEQ ID NO: 725 - protein, 274 aa, Methylopila sp. M107
MTRELERRRRGRPKGFHESSVGPIRSIERAFDVLEVLASSDGVTLSELSERLGQSVTTMHRVLSTLERRRYAEHVIDCQEWHVGSQAFRLGSSFLRRNDVVEQSRPDMRELMLATGETSNLGIERQGDVLFVSQIETHESIRAFFPPGTLSPLHASGIGKALLSAFDAQRLARFLHTTELTCFTETTITSRDKLVDEVRQIQGRGYALDNEERSLGMRCVAACVTDMYDEVVAGISVSGPVSRLPLAAIPEIGMLVKQAAQRISEKMGASQFDK

SEQ ID NO: 726 - protein, 293 aa, Loktanella sp. SE62
MFFSYDEFVFHMRWKMARDITKTRGRPKAWDDKTAQNTLKSLDRALEVLIALGEMEGGTLSELAKALNQSPATVYRVLTTFRQRGFVDFDEQNQTWYIGPTAFLTGSRFLRRTSLVERARPVMRELMEATGETANLGIERDGKVLFLGQVETHATIRAFFPPGTVSAMHASGIGKALLAWMDDARQRRVLAAGRLERFTPHTLTEPEPMIADLHASRARGYAIDGEERNLGMRCIAAPVFNLYGEAVAGISVSGPTARMSEDRVPELAASVMSAAGRLSAAIGGSGNSRALAP

SEQ ID NO: 727 - protein, 271 aa, Phaeobacter gallaeciensis ANG1 (ANG1); identical to SEQ ID NO: 624

SEQ ID NO: 728 - protein, 281 aa, Rhodobaca barguzinensis DSM 19920
MAEPRTRGRPRAFHDKSEQNTVQSLDRALGILRVLSESSGLTLTELAQAADQSPATVYRVLSTFQAHGMVELEAEGQRWHVGAGAFRVGSAFLRRTKLAERARGAMQTLMRETGETANLGVEEKDEVLFLTQVETHEAIRAFFPPGTRSPMHVSGIGKALLAYYPITRVARIMAQGLPGFTAASLTDGIALENDLIDTRARGYAIDNEERTEGMRCIAAPIFNAHGEPVAGLSISGPVFRLSLERAKDMGELVRTAAAGVTEATGGRVPQKGAAGSLARPG

SEQ ID NO: 729 - protein, 273 aa, Mameliella alba DSM 26384
MNSPKRPRGRPKSAFKESSAGTLQALDRALGVLTALARDEGTTLSDLSREIDIPTATTHRILTTLENHRFVTFDEERQEWAVGIEAWRTGTAFLKRNSVVEVGRPVMRRLMKETGETANLAVPDGLEVVFVGQVETPNPIRAFFPPGTRTAMHASGIGKAILAAMRPQAQQRLIEDMDLTPFTASTHVTLSGLTADLHSIAARGWSHDREERHAGMSCIGAAILNDQGEPCAGISVSGPTVRFSGEGIADLGRRVAEAAQEITDLSGGAMRDV

SEQ ID NO: 730 - protein, 279 aa, Paracoccus denitrificans DSM 15418
MSVQIRKRGRPRGRAGGLGAEDSGGIRALDRALDILDLIAVSSGLTLTEIAQRLDMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPLDLKRMLREMRLERFTDMTLTDPAALVEDLVQIRARGYALDNEERTPGMRCIAAPIFDLAGEAAAGISVSGPTLRMSDARLSAMSDAVIEAARELSFGMAPREDAGERA

SEQ ID NO: 731 - protein, 276 aa, Ruegeria halocynthiae MOLA R1/13b
MENQKRPRGRPKSLFKESSAGTMQSLDRALGVLTTVARLERAALSDLAREVGVPTATTHRILVTLQKHGFVAFDEERQEWMTGIEAYRTGASFLRRNSVLEIGRPILRRLMQDSGETANLAVPDGAEVVFVGQVETLNPIRAFFPPGARTPMYASGTGKAILAAMSDDGLARTLAIANPVPFTGNTLVQEKTLRSDLSETRARGWSHDREERYEGMSCIGAAIFNERAEPCAGISVSGPTVRFDAARAPELGARVVEAAQEITRLSGGRNPNVPGD

SEQ ID NO: 732 - protein, 279 aa, Paracoccus denitrificans DSM 413; identical to SEQ ID NO: 603

SEQ ID NO: 733 - protein, 286 aa, Roseivivax isoporae LMG 25204
VATGDDTPESGRRARGRPRGWHDRTEQNTIKSLDRAMEVLDRLSELPGVSLSALAADLDQSPATVYRVLTTLEGRGLVEFDAEAQLWHVGAQAFVIGARFLRRTSLVERARPILRNLMEATGETANLGVARGPAVLFVSQVETDASIRAFFPPGTLSPMHASGIGKALLARMDERRLARLLSTPLERFTEHTFCDADALRTELAATRARGWALDGEEKTLGMRCIAAPVFDMSGEAVAGVSVSGPVSRVSDGSIDRVAQEVCAAAAALTAAVGGVWPAPAGAGGRG

SEQ ID NO: 734 - protein, 280 aa, Citreicella thiooxidans DSM 10146
MDSPKDAEISPRRARGRPRGWEDNSAQNTIKSLDRAMEVLEYLSSRPGLTLSELAGDLDQSPATVYRILVTLEGRRLVEFDPTEQLWHIGPQAFVIGARFLRRTSLVERARPILRGLMEETGETANLGIVREASVLFVSQVETHESIRAFFPPGTLSPLHASGIGKALLAEMPGERLEKLRARPMERFTPHTLASPEALLNDLAAIRERGYSIDAEERNLGMRCIAAAVFDASGEAVAGISVSGPTIRMGEESTHEASRAVMRAARELTAAIGGVRPPVR

SEQ ID NO: 735 - protein, 282 aa, Antarctobacter heliothermus DSM 11445
MDSQGNRDEPRRKARGRPRGWEDKTAQNTIKSLDRAMAVFEYLSEAQGKPLTLLADEMGQSPATVYRILVTLEGRGLVEFDPEEQVWHIGPRTFVIGARFLRRTSLVDRARPIMRKLMEATGETANLGIEKEGAVLFLSQVETHANIRAFFPPGTLSAMHASGIGKALLAQMDDDRLDRHLATSELTAFTDCTLADPEALKADLRTIRAQGYSVDNEEKNTGMRCIAAPVFDMNQEAVAGISVSGPTSRVSVAQIEQLSRPVMEAARDLTFAIGGAVAEPPT

SEQ ID NO: 736 - protein, 274 aa, Nitratireductor sp. ZZ-1
MAPQVGRARGRPRSFHNTAQNSLIQSLDRAMDVLKVVAGGSGLSLTEIADRSGQSASTAYRILITLEKHRVVQFDEPAQLWHVGLEAFRIGSSFLGRTSIVEQSRPVMQRIMAETGETANLAIIDRGEVIFVSQVETHEPIRAFFRPGTRGPVHASGIGKALLAFLPEIQAQTILKQGAQDAYTDKTIVSGEALAAEMATIRTRGWAIDDEERTPGMRCIAAPIFNQFGEAVAGVSLSGPAFRITPKRDADYGVLVRKAADEITRAIGGMPPRG

SEQ ID NO: 737 - protein, 269 aa, Rhizobium sp. CNPSO 671
MQNLNRRRGRPKSFNEPQSSSVIQSLDRALDVLEALASPEGMTLSELSAHLDQSPATMHRVLATLERREFVEISPDRQVWFIGPEAYRTGAAFLRRSNVVERSRPIMRELMLETGETSNLGIEKDGNILFISQVETHESIRAFFPPGTLSPLHASGIGKALLSTYDDGRLSALFKTSTLKRFTENTARSVAQLKEELIVSRERGYAIDDEERTKGMRCVAAPILNVHGEAVAGISVSGPTHRMPDRLIKQIGERVAGAAKTVSRRLGGG

SEQ ID NO: 738 - protein, 266 aa, Pseudomonas stutzeri NP_8HO
MADPTRKRGRPRKTLPDAPGTVQSLDRALDLLDLLAAHPGLTLSEVADRSAQPPSTVHRVLHTLAARGMAESDPATQAWNIGPQAFRLGSAFMRRSGLVERARPIMRALMEHTGETANLGILQGDSVLFLSQVETSETIRAFFPPGTRSPLHASGIGKALLAFRPDSVAALGPLARFTDTTLTDPAALEADLARIRHRGFSFDDEERSRGMRCIAAPVFDLSGEAIAGISVSGPTHRIGAEHVKTLGAVVAAAAANLSDALGGPTR

SEQ ID NO: 739 - protein, 251 aa, Pseudomonas stutzeri NP_8HO
MADPTRRRGRPCADGPDRPLTVQALDRALDMLDLLSLHPGLTLSEVAQRTGLPASATHRILQTLALRGMVERCAATQCWSVGPSSFRLGAAFLRRSGLIARARPILQDLVARTQETANLGILSDGGVLFVSQVESDQPIRVAFPPGTRASLTGSGIGRAMLAINAGPAPDTACPDLARIRRQGFAFDDQGRMAGMRCVAAPIVDMAGRAVAGLSINAPAHRIRTRQVGAIGAAVAEAAARLTAVTGEQLHL

SEQ ID NO: 740 - protein, 273 aa, Pseudomonas stutzeri NP_8HO
MQQPVRKRGRPKGGKADQPAASIQALDRGLDVLEALAAHEGITLTGLSTHLDQSPATMHRVLATLEHRRYVENNPDRQEWFIGPEAFRLGSAFLRRTNIVERSRAVMRDLMALTGETANLGIERDGDVLFVSQVETHQTIRAFFPPGTRSPLHASGIGKALLAAFDQTRLAMFLRDATFTRFTDKTIADADALQADIALIRHRGFAFDDEERTLGMRCVAASIVNSYGEAVAGVSVSGPTNRMTDAAVDRIGGMVATAAERISADLGSGRGGR

SEQ ID NO: 741 - protein, 273 aa, Ruegeria sp. ANG-R
METQKRPRGRPKSLFKESSAGTMQSLDRALGVLTTVARSERSSLSDLAREVGVPTATTHRILVTLQKHGFVTFDEERQEWMVGIEAYRTGASFLRRNSVLEIGRPILRRLMQDSGETANLAVPDGAEVVFVGQVETQNPIRAFFPPGARTPMYASGTGKAILAALSEEGLKKVLGATDLTAFTENTYLPGPGLYEDLTETRARGWSFDREERYEGMSCIGAAIFNDRAEPCAGISVSGPTVRFSSEHAPELGELVLNAAQEITYLSGGRLPKG

SEQ ID NO: 742 - protein, 273 aa, Mameliella alba CGMCC 1.7290; identical to SEQ ID NO: 729

SEQ ID NO: 743 - protein, 269 aa, Pseudorhodobacter antarcticus CGMCC 1.10836
MADEQRSRGRPKRFDGDESQNIIQSLDRAIDVLETLAQGGAMTLSQVASTMDQSPATIYRVLSTFRVRGMAEVNPASQEWSVGAEAFRIGSAFLRRSNVIARAMPIMQQLRDETGETSNLGIERDDNVVFIAQVETHESIRAFFPPGTQAPMHASGIGKALLAMFPEKHLARYLAQAHLPPFTANTICTPDGLRAHLVQIRTQGYSFDDEEKAIGMRCIAAPIVNFHGDAVAGVSISGPSHRLPCDGVARIGALVKAAGDKISASLGAL

SEQ ID NO: 744 - protein, 279 aa, Loktanella sp. DSM 29012
MDSQDNLSSTGRRARGRPRDWDDKTSQNTIKSLDRAMEVFEFLSEAQGKALTTIATEMGQAPATVYRVLVTLEGRGLVEFDAVEQIWHIGPTAFVIGSRFLRRTSLVDRARPVLRKLMENTGETANLGAERDGSVLFLSQVETHSNIRAFFPPGSLSPMHASGIGKALLAEMDAGHLERTIDGAPLTAFTLHTITDKDALLADLETTRDRGYALDGEEKNLGMRCIAATVFDVNAEPVAGISVSGPTSRVGANDIPRLSLAVIDAARELTAAIGGIRPR

SEQ ID NO: 745 - protein, 279 aa, Paracoccus thiocyanatus ATCC 700171
MSVQIRKRGRPRGRAGGPNAEDSGGIRALDRALDILDLIAVSSGLTLTEIAQRLGMAPSTVHRVLVTLAARGVAESDSQTQAWHVGPTAFRHGSAFMRRSGLVERARPLLRRLMEQTGETANLGILNGDAVLFLSQAETHETIRAFFPPGTRSALHASGIGKALLAHAPPADLKRMIAGMALERFTPTTLTDPQALVQDLVRIRARGYALDNEERTPGMRCIAAPIFDLGGEAAAGISVSGPSLRMSDARLASMSQAVIEAARALSFGMAPDPAPRDGT

SEQ ID NO: 746 - protein, 275 aa, Rhodovulum sulfidophilum TUT; identical to SEQ ID NO: 662

SEQ ID NO: 747 - protein, 269 aa, Roseovarius sediminilitoris DSM 29439
METPKRRMGRPKNFNSNEKQTTILALDRALDVVDALAHANGMTLSQLSAHLDQSPATMHRVLATLHARNFVEMDERAQTWHIGSAAFRMGSAFLRRSSIVERSRPIMRELMEATGETSNLGIERNGVVMFISQVETQESIRAFFPPGTLSPMHASGIGKALLSCYSETRTNQYLRMAELTRFTEKTIILPDMLKNELTVIREKGWAFDDEEKAEGMRCIAAPIRDIYGEAVAGVSISGPTHRIPKSEVERIGALVSDAAAQVSRGLGSS

SEQ ID NO: 748 - protein, 277 aa, Leisingera sp. ANG-M1
MPQPPRRKGRPKSFDSASQPATIQSLDRALDVLDALAGANGMTLTELSASLDQSAATMYRVLSTLEARQIVEIEPQSQTWHIGAMAFRLGSAFLRRSSVIERARPVMRELMEATGETSNLGIERGGDVMFVSQVETHESIRAFFPPGTTSPMHASGIGKALLSCFEEDQLTRFLRGRTLEQFTAKTLTSPDALRADLAQIRSRGWSFDDEEKAPGMRCVAAPVFGMQGEVLAGISISGPTARMPDGGISGIGALVKDAAQKLSYGLGAPAADETPPG

SEQ ID NO: 749 - protein, 270 aa, Roseovarius azorensis DSM 100674
MTQPKRPRGRPKSQFSESSAGTMQALDRALGVLTAVAREEGVNLSDLSLSLGIPTATTHRILTTLQQRDFVRFDEERQDWTIGIEAYRTGVAYLKRTNLADAGRPVMRRLMEQTGETANLAVPDGAEVVFIGQVETQNPIRAFFPPGSRTPMHASGTGKAILAALPEERLLALLKGAGLKGFTDKTHVTPRALFDDLAQTRARGWSFDRNERYDGMSCIGAAIFNDRGEPCAGVSISGPSSRFADMQIAEFGRAVAQAAAQITHLVAGRS

SEQ ID NO: 750 - protein, 275 aa, Sulfitobacter pseudonitzschiae DSM 26824
MVSQDNPPSEPRRARGRPRDWSDKTAQNTIKSLDRAMEVFEFLSEHQGKALTTLATETDQSPATVYRILVTLEGRGLVEFDAVEQLWHIGPRAFVIGARFLRRTSLVERARPVMRRLMEQTGETANLGIERGGQVLFVSQVETEATIRAFFPPGTLSPMHASGIGKALLAEMDDARLQRALAGKTLTAFTPHSITDLNALRADLAQVRARGYAVDAEERNIGMRCIAAPVFDIHQEAVAGISVSGPTSRVGLEDIERLSVAVRAAAADLSATLGG

SEQ ID NO: 751 - protein, 275 aa, Ruegeria sp. CECT 5091
METQKRPRGRPKSLFKESSAGTMQSLDRALVVLTAVARMERAALSDLAREVDVPTATTHRILATLQKHGFAAFDDERQEWMIGIEAYRTGASFLRRNSVIEIGRPILRRLMQDSGETANLAVPDGAEVVFVGQVEAQNPIRAFFPPGARTPMYASGTGKAILAAMSESAASKVLAAEAVRFTSHTLLPGEGLREDLANTRSRGWSHDHEERYEGMSCIGAAIYNDRGEPCAGISVSGPSVRFIADRAMELGALVRDAAEEITQLSGGRLPKPSEE

SEQ ID NO: 752 - protein, 282 aa, Pseudoruegeria haliotis DSM 29328
MKSPNNGGRAIRKSRGRPRDFHDKTPQNTIKSLDRAMEVFEYLSTTQGRALSELAAEMDQAPATIYRILITLEGRKLVEFDPTSQVWYIGPRAFVIGARFLRRTSLVDRARPVLRQLMEDTGETANLGIEQNGRVLFVSQVETHASIRAFFPPGTLSRLHASGIGKALLAQMAPDRIERFLNAAPLERFTEFTLTGRDELLEDLEATRQRGFALDGEERNLGMRCIAAPIFDVHNEAVAGISVSGPTSRVSPEQIPALSAAVLTAAKNLTDAIGGSAILPPA

SEQ ID NO: 753 - protein, 264 aa, Pararhodobacter aggregans DSM 18938
MTESRRGRPKAFHDKTEQNTIRALDRAMALLQALAGSDGMTLTELAQAEGESPATTYRVLTTLAQRQMVELDPRGQVWYVGAGTFRTGAAFLRRTNVVERARAPMQALMRATNETANLGIEQQGEVLFLTQVETHQAIRAFFSPGTRSALHASGIGKALMAWMPGLNPGPLTRFTEATITEPEALARNLALTRSRGWALDNQERTEGMRCVAAPIFNAHGEPVAGVSISGPVFRLPPDALPELGARVRAAAAEITRSIGGAVKS

SEQ ID NO: 754 - protein, 279 aa, Rhodovulum kholense DSM 19783
MTQPRLRGRPRAFHDKTEQNTVRALDRAMGLLSALSETKGLTLSELATLTGQSPATVYRVLITLQGHDIVELEDEAQRWHVGPGAFRIGSGFLRRTNVAERSRGAMQTLMRATGETANLGVEDRDEVLFLTQVETHEAIRAFFPPGTRGPMHTSGIGKALLAHLPPARVAAILKSKGLPGFTPLSITDEAALGEDLARTRARGYAIDDQERAEGMRCIAAPIFNAHGEPVAGLSVSGPAFRIPLEAAARIGTEVRAAADRVTAAIGGTVGLAGAAEKSA

SEQ ID NO: 755 - protein, 269 aa, Rhizobium yanglingense LMG 19592
MTVPIRRRGRPKGFNDPQTQNVVQSLDRALDVLEALASPEGMTLSELAKHLDQSAATMHRVLATLERRDYVEMSPDGQIFHIGPEAYRLGAAFLRRTNVIERSRPVMRELMLETGETSNLGIEKNGKVLFVSQVETHESIRAFFPPGTLSPLHASGIGKALLSTYDEERLAFLFKGATLQRFTANTLRTIDQLKEELEITRQRGYAFDDEEKAAGMRCVAAPVLNIHGEAVAGISVSGPAHRISDRQVKRIGQRVIEAARLVSNRLGAS

SEQ ID NO: 756 - protein, 286 aa, Labrenzia sp. C1B70; identical to SEQ ID NO: 717

SEQ ID NO: 757 - protein, 272 aa, Starkeya novella DSM 506 chromosome
MTQAVPIVRRRGRPSSTGGAEPGGEVQSLDRAIALLEVLARSDGLSLSELARSAELPTSTVHRLLTTLERRGLVGHDAATGSWMVGVGLFRVGSAYLRIRKLPEIARALLRELSHGVNETVNLSLIDGPHLICVAQVESHAAVRAFFRIGGDLPIHASGGGKAILATMNPEARRAWLGDDQLQRFTEHTHVSRRALQADLAEIAARGYSIDDEEHTPGMRCVAAAVLDEWREPVGAISISAPTVRMPPERIADLGAQVREAAARLTLRYSGR

SEQ ID NO: 758 - protein, 279 aa, Ruegeria mobilis 45A6
MDSQENAPKATRRARGRPRDWHDKTAQNTIKSLDRAMEVFEFLSEAQGKPLTMIAEEMGQSPATVYRILVTLEGRGLVEFDTEEQLWHIGARAFVIGARFLRRTSLVDRARPILRKLMEETGETANLGIEKEGHVLFLSQVETHASIRAFFPPGTLSQMHASGIGKALLAQMDVGRLDRLLATTRLEVFTDHTITDHEALKQDLTAIRAQGFAVDNEEKNAGMRCIAAPVFDMNREAIAGISVSGPTSRISAQEITQLSRPVIEAARALTLAIGGDVAP

SEQ ID NO: 759 - protein, 278 aa, Oceaniovalibus guishaninsula JLT2003
MDSPNNGAPEPTGRRPRGRPRAFDEKTEQNTIKALDRAMDILRALSRMDGATLTALAQETGDVPATVYRVLVTLQAHGIVEADEAAQTWHVGPGAFLIGSAFLRRTSLVERSRPALRRLMEQSGETANLGIASDDRVLFVSQVETHAPIRAFFPPGTRSAMHASGIGKVLMAAMDAPRLERIVAAGLTRYTPRTLTEPNALLADLEAIRKRGYAIDDEERNLGMRCIAAPIRNAHQEVIAGLSVSGPISRMTPDKTEALAVRVMTAAASVSAGMGARD

SEQ ID NO: 760 - protein, 289 aa, Loktanella vestfoldensis DSM 16212
MQLRFSYGENIFQKVSHLQHEARKTRGRPKAWDDKAAQNTVKSLDRALEVLVALGEMQGGTLSEIASALRQSPATVYRVLTTFQGRGFVDFDRQAQVWSIGAAAFLTGSQFLRRTSLVERARPIMRDLMEATGETANLGIERDGKVLFLGQVETHATIRAFFPPGTVSAMHASGIGKALLAHMDDARQRRVLAASKLEQFTPLTLTDPEAMIADLHATRMRGYAFDGEERNLGMRCIAVPIHDVSGEAVAGLSVSGPTTRIADDKIAELAQAVMAAAARLTAAIGGTPR

SEQ ID NO: 761 - protein, 269 aa, Rhizobium etli bv. mimosae Mim1
MTVPVRRRGRPKGFNDPQTQNVVQSLDRALDVLEALASPEGMTLSELAKHLGQSAATMHRVLTTLERRDYVEMSPDGQIFHIGPEAYRLGAAFLRRTNVIERSRPVMRELMLETGETSNLGIEKNGKVLFVSQVETHESIRAFFPPGTLSPLHASGIGKALLSTYDEERLGVLFKGATLQRFTANTLRTIDQLKEELEVTRQRGYAFDDEEKAAGMRCVAAPILNVHGEAVAGISVSGPAHRMPDRQIKRIGQRVIEAARLVSNRLGAS

SEQ ID NO: 762 - protein, 271 aa, Methylobacterium komagatae DSM 19563
MDSGNRRRGRPKGFGGAKPTETIQALDRALDVLDVLAESDGLTLSELAGKLGQSVATMHRVLATLERRAFVEISADKQEWHVGAEAYRLGSAFLRRHNVVERSRPMMWTLMQETGETSNLGVEKEGSVLFVSQVETHETIRAFFPPGSLSPLHASGIGKALLATYEPDRTERLFRGKTFARFTDKTIGSLEQLREDIEATRHRGYAIDDEERTIGMRCVAAPILNFHGEAIAGISVSGPTHRLSDEKLKEIGERVRKGAATVSRLLGATTA

SEQ ID NO: 763 - protein, 269 aa, Rhizobium tropici YR635
MPQEPRRRGRPKAFNGPQTQNTIQALDRALDVLDALATPEGKTLSELAGQLGQSAATMHRVLATLERREFVEISPDRQVWHIGPEAYRLGAAFLRRSNVVERSRPIMRELMLETGETSNLGIEKDGNVLFISQVETHESIRAFFPPGTLSPLHASGIGKALLSTYDEDRLSALFRKKEFERFTENTVRSFEQLREELQKTRERGYSFDDEERTKGMRCVAAPILNVHGEAVAGISVSGPIHRLPDADIHQIGERVRSAARMVSRRLGAP

SEQ ID NO: 764 - protein, 269 aa, Aurantimonas altamirensis DSM 21988
MAGEIRRRGRPKAFNEPEGEARVKAVDRALDVLDAIAASDGISLSRLADQLDESVATIHRVLGTLEHRDFVECGADDQLWRVGSGAFRLGSSFLRRTNVVEQSRPALRQLMQLCGETANLGMEKEGFVLFLSQVETHEAIRAFFPPGTLSPLHASGIGKALLSTYDAPRFETFCATVPMVRFTDKTLTSAQDLARDIALARQRGFAVDDEEKSPGMRCVAAPIRNHHGEAVAGISVSGPTHRMGTERLDEIGAHVKAAATEVSRRLGAA

SEQ ID NO: 765 - protein, 275 aa, Sulfitobacter sp. MCCC 1A00686; identical to SEQ ID NO: 750

SEQ ID NO: 766 - protein, 286 aa, Methylobacterium sp. 13MFTsu3.1M2
MDSGNRRRGRPKGFGGAKPAATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGKTFARFTDKTIGSLDQLRDDVEATRRRGYAIDDEERSIGMRCVAAPILNVHGEAIAGISVSGPTHRLSDEKLRAIGERVRRGAAAVSRALGAPAATMTATPDAPGAPDRD

SEQ ID NO: 767 - protein, 286 aa, Methylobacterium sp. 275MFSha3.1
MDSGNRRRGRPKGFGGAKPAATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKEGNVLFVSQVETHETIRAFFPPGSLSPLHASGIGKALLSTYAPARTERLFRGKTFARFTDKTIGSLDQLRDDVEATRRRGYAIDDEERSIGMRCVAAPILNVHGEAIAGISVSGPTHRLSDEKLRAIGERVRRGAAAVSRALGAPAATMTATPDAPGEPDQD

SEQ ID NO: 768 - protein, 279 aa, Paracoccus pantotrophus DSM 11073; identical to SEQ ID NO: 645

SEQ ID NO: 769 - protein, 284 aa, Marinovum algicola DSM 10251
MVLMDSQDNGGKRGPRRARGRPRGWEDKTAQNTIKSLDRAMEVFEYLSAAQGRSLTALASETRQAPATVYRILVTLEGRGLVEFDAEDQTWHIGPRAYVIGARFLRRTSLVDRARPYLRRLMEDTGETANLGIEQEGAVLFLSQVETHASIRAFFPPGTLSPMHSSGIGKVLLAQMDDARLGRFLAATRLEVFTDHTITDREALRADLRKVRARGFSIDNEEKNAGMRCIAAPVFDLNGEAIAGISVSGPTSRVSMAEVDRLSRPVIAAARDLTHAIGGIMREV

SEQ ID NO: 770 - protein, 279 aa, Paracoccus versutus DSM 582
MSVQIRKRGRPRGRAGGLGAEDSGGIRALDRALDILDLIAVSSGLTLTEIAQRLEMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPADLKRMIREMRLERFTEMTLTDPQALLDDLARIRARGYALDNEERTPGMRCIAAPIFDLAGEAAAGISVSGPSLRMSDARLEAMSEAVIEAARELSLGMAPHAGAGEER

SEQ ID NO: 771 - protein, 281 aa, Thalassobius aestuarii DSM 15283
MDSQENGPNEGRRARGRPRDWHDKTEQNTIKSLDRAMAVLEYLSRSKGLPLTRIAEDMGQSPATVYRVLVTLEGRGLVDFDADEQVWNIGPGAFVIGARFLRRTSLVDRARPIMRKLMEDTGETANLGIEKEGSVLFLSQVETHETIRAFFPPGTLSDMHSSGIGKALMAHMETDRLQRVLAKSSLQAFTEYTITDRDALMQDLAQIRARGFSIDNEERTAGMRCIAAPVFDMNGEALAGISVSGPTSRVSPEEIARLGAPVTEAAKALTQAIGGVAPALT

SEQ ID NO: 772 - protein, 281 aa, Litoreibacter janthinus DSM 26921
MSDFFDEAQTHRNRGRPRAWDDKTSQNTIKSLDRAMGVLDYLSTLQGATLSELASDLGESAATVYRILVTLQSRELVEFDADGQLWHVGPRAFLIGTRYLRRTSLVDRARPILRRLMEITGETANLGIARNAHVLFVSQVESHASIRAFFPPGTLSPMHASGIGKALLAEMPADRLSRVLAAAPLERFTDKTHTDAGALRADLTEIHARGYSVDDEEKNLGMRCIAAAVFDWHGEAVAGISVSGPLSRMSIEQTRELAKAVTTAAADLSAALGAETRVKPA

SEQ ID NO: 773 - protein, 251 aa, Paracoccus sp. 361
MADPTRRRGRPCADGPDRPLTVQALDRALDMLDLLSLHPGLTLSEVAQRTGLPASATHRILQTLALRGMVERCAATQCWSVGPSSFRLGAAFLRRSGLIARARPILQDLVARTQETANLGILSDGGVLFVSQVESDQPIRVAFPPGTRASLTGSGIGRAMLAINAGPAPDTACPDLARIRRQGFAFDDQGRMAGMRCVAAPIVDMAGRAVAGLSINAPAHRIGTRQVGAIGAAVAEAAARLTAVTGEQLHL

SEQ ID NO: 774 - protein, 273 aa, Paracoccus sp. 361
MQQPVRKRGRPRSGKADQPAASIQALDRGLDVLEALAAHEGITLTGLSTHLDQSPATMHRVLATLEHRRYVENNPDRQEWFIGPEAFRLGSVFLRRTNIVERSRAVMRDLMALTGETANLGIERDGDVLFVSQVETHQTIRAFFPPGTRSPLHASGIGKALLAAFDQTRLAVFLRDATFTRFTDKTIADADALQADIALIRHRGFAFDDEERTLGMRCVAASIVNSYGEAVAGVSVSGPTNRMTDAAVDRIGGMVATAAERISADLGSGRGGR

SEQ ID NO: 775 - protein, 266 aa, Paracoccus sp. 361
MADPTRKRGRPRKTLPDAPGTVQSLDRALDLLDLLAAHPGLTLSEVADRSAQPPSTVHRVLHTLAARGMAESDPATQAWNIGPQAFRLGSAFMRRSGLVERARPIMRALMEHTGETANLGILQGDSVLFLSQVETSETIRAFFPPGTRSPLHASGIGKALLAFRPDSVAALGPLARFTDTTLTDPAALEADLARIRHRGFSFDDEERSRGMRCIAAPVFDLSGEAIAGISVSGPTHRIGAEHVKTLGAVVAAAAASLSDALGGPTR

SEQ ID NO: 776 - protein, 281 aa, Paracoccus homiensis DSM 17862
METQENHPSRERRARGRPRGWDDKTAQNTIKSLDRAMQVFEYLSEDQGTTLTRLADGMGQSPATVYRILVTLEGRGLVEFDPDEQVWHIGPRAFVIGARFLRRTSLVERARPIMRKLMEVTGETANLGVEKEGLVLFLSQVETHASIRAFFPPGTLSALHASGIGKALLAHMDRDRLDRLLSARDLQAFTHSTITRQDALRDSLSEIRALGYAVDHEERNEGMRCIAAPVFDINQEVVAGISVSGPTTRVNPAAVQRLSQPVIEAARDLTLAIGGRPLAVT

SEQ ID NO: 777 - protein, 266 aa, Paracoccus homiensis DSM 17862
MPQPSRRRGRPRSGADSAGTIQSLERALDILDMLAGHSGLTLSEVADKMQQSPSTVHRVLHTLASRGVVESDPATQSWQIGPAAFRLGSAFMRRSGIVERARPVLRALMEHSGETANLGILNGECVLFISQAETQETIRAFFPPGTRSPLHASGIGKALLAFGRPQTLDQTLAQAPLQRFTDKTLTQPQELRDDVARIRARGFAFDDEERTRGMRCIAAPVFDLTGEAVAGISVSGPTHRIGSEHVKTLGAVVAAAAADLTQKMGG

SEQ ID NO: 778 - protein, 273 aa, Ponticoccus sp. UMTAT08
MNSPKRPRGRPKSAFKESSAGTLQALDRALGVLTALARDEGTTLSDLSREIDIPTATTHRILTTLENHRFVTFDEERQEWAVGIEAWRTGTAFLKRNSVVEVGRPVMRRLMKETGETANLAVPDGREVVFVGQVETPNPIRAFFPPGTRTAMHASGIGKAILAAMRPQAQQRLIEDMDLTPFTASTHVTLSGLTADLHSIAARGWSHDREERHAGMSCIGAAILNDQGEPCAGISVSGPTVRFSGEGIADLGRRVAEAAQEITDLSGGAMRDV

SEQ ID NO: 779 - protein, 286 aa, Methylobacterium sp. Leaf361; identical to SEQ ID NO: 655

SEQ ID NO: 780 - protein, 278 aa, Aestuariivita boseongensis BS-B2
MAEEPPQIAESRRARGRPRDWHDKTAQNTIKSLDRALEVLETLSDMGGATLSELAAEADQSPATVYRVLITLEGRGMVEFNPTEQLWNIGARAFLIGSRFLRRTNLVERARPILRQLMEATGETANLGMERAGQVLFLSQVETHASIRAFFPPGTLSPMHSSGIGKALMAQLSDARLDGIIAEHGLDQFTPHTLTDPDMLKADLAATRDRGYSIDAEERNEGMRCVAAPVFDAYGDVVAGISVSGPSSRIVDHMIAGFGEQVSQAAADLSRAIGADRP

SEQ ID NO: 781 - protein, 281 aa, Paracoccus isoporae DSM 22220
MAIPDNPESGPRRTRGRPRGWDDKTAQNTIKSLDRAMAVFDHVSRGSGLALSTIAAETQESPATIYRILVTLAGRGLVEFDAEAQLWHIGPHAFTIGTRFLRRTSLVDRARPVLRRLMEATGETANLGVEREGAILFVSQVETHASIRAFFPPGTLSPMHVSGIGKALLAAMPQDRLERLLAGQDFASFTEHTITDRDRLADELRRIRARGYAVDDEERNLGMRCIAAPVFDMNAEAVAGVSLSGPTSRVTPDAVVGLSGEVIAAAEALTRAIGGVARREV

SEQ ID NO: 782 - protein, 270 aa, Aminobacter aminovorans KCTC 2477
MIEQAGKRRGRPKGSKSSSPATSIQALDRGIDVLEALAAHDGITLTELSAHLGQSSATMYRVLATLEQRRYVETSPERQEWFVGPEAFRLGSAFVRRTNIVERSRSIMRELMSKTGETSNLGIEREGHVLFVSQVESHETIRAYFPPGARSPLHASGIGKALLSAFDEERLEAFIKATNFTRFTDKTIATAGRLREEMHATRQRGYSFDDEERTIGMRCVAACILNGYSEAVAGISISGPTPRMPDARIREMGLLVTEAAHEISRRLGAS

SEQ ID NO: 783 - protein, 278 aa, Aminobacter aminovorans KCTC 2477
MATMEKRQRGRPRAFQPASDAGSVQSLDRALRILAIVAHGDGLSLSEISAASDLAAATAYRMLTTLQNHGMVEFDSDGQLWSIGVETYRMGAAFLRRRKLVDRARAVMQELMEKTGETANLGVAEDDCVVFVSQVETHQAIRAFFRPGTRSPFHASGIGKAVLAHLDRERVNAIVRKAGLDAYTERTLSEPALLARDLEKIRSRGWSVDDEERYPGMRCIAAAVFNEFGEPIGGVSVSGPTVRVTSERLGEIGPIVRDAAAELTRMIGGSPEGTVPGL

SEQ ID NO: 784 - protein, 275 aa, Loktanella litorea DSM 29433
MDQDVKRGRGRPRAWDDKGDQNTIKSLDRALEVLVKLGELQGATLSELASALDQSPATVYRVLTTFQGRGFVDFDEIGQTWNIGPAAFMTGSHFLRRTSLVERARPIMRHLMEATGETANLGIERGGKVLFLGQVETHATIRAFFPPGTEGAMHSSGIGKALLSRMDDARQRQVLAASKLEKFTPHTLTDPETMIADLRETRARGYAFDGEERNIGMRCIAAPVFNVYGEAVAGISVSGPTSRITDDRIQVLAEEVIDAAERLTRATGGNYRPAG

SEQ ID NO: 785 - protein, 279 aa, Rubrimonas cliftonensis DSM 15345
MNMTVKRPRGRPRGADADRGGAVQSLERALGLLTALARQDSATLSDLALRTGTPPSTAHRLLTTMEASRYVAFDEATNLWTIGVEAFRTGSSFLRQTRVVDAARDVMRELVELTGETANVAVPDGGEVVFVSQVETSHPIRAFFGPGARAHMHASGIGKALLAAMGRAEVERRLQKVGLPEFTPNTLASPAALFADLERIRGRGWSLDDEERNLGMRCVAAAIRNAHGEAVAGVSISGPCVRLPHDRVAEVGPMVRRAAARITERIGGAQPDESAAAAS

SEQ ID NO: 786 - protein, 274 aa, Planktotalea frisia SH6-1 (PFRI); identical to SEQ ID NO: 695

SEQ ID NO: 787 - protein, 268 aa, Aureimonas altamirensis ON-56566
VGEIRRRGRPKAFNEPEGDARVKAVDRALDVLDAIAASDGISLSRLADALGESVATVHRVLGTLEHRDFVECGTDDQLWRVGSGAFRLGSSFLRRTNVVEQSRPALHQLMQLCGETANLGMEKEGFVLFLSQVETHEAIRAFFPPGTLSPLHASGIGKALLSTYDAPRFRSFCEKAPMLGFTAQTLTSAEDLARDIALTRQRGFAVDDEEKSPGMRCVAAPIRNHHGEAVAGISVSGPTHRMGTERLEEIGAHVKNAATQVSRRLGAT

SEQ ID NO: 788 - protein, 275 aa, Ruegeria sp. ZGT108
MENRKRPRGRPKSLFKESSAGTMQSLDRALNVLTTLARMERAVLSDLAREVDVPTATTHRILATLQKHSFAAFDDDRQEWMIGVEAYRSGASFLRRNSVIEVGRPILRRLMEESGETANLAVPDGAEVVFVGQVETPNPIRAFFPPGARTPMYASGTGKAILSAMSDTASSKVMSADAERFTSFTLLPGEGLRADLAETRARGWSHDHQERYEGMSCIGAAIFNDRGEPCAGVSVSGPSVRFSQDRAAGLGALVMRAAQEITELSGGRLPERSKR

SEQ ID NO: 789 - protein, 266 aa, Paracoccus sediminis DSM 26170
MSEPTRRRGRPRSAKDQGGTVQVLDRALDMLDLLAAHPGLTLSEVADRMDQSPSTVHRLLHSLAARGMVESDPATQAWNIGPATFRLGSAFMRRSGIVERARPILRALMEHTGETANLGILNGDAVLFVSQAETHETIRAFFPPGTRSPLHASGIGKALLAFGRPEVLRGYLDGPGLKRFTDKTQVTVDALAQDMARIRARGFSFDDEERTRGMRCIAAPVFDMSGEAIAGVSVSGPSHRIGHEHVKTLGAVVAAAAAELSAAMGG

SEQ ID NO: 790 - protein, 286 aa, Ruegeria scottomollicae DSM 25328
MDSQETGPKTTRRARGRPRDWHDKTAQNTIKSLDRAMEVFEFLSEAQGKPLTSIAEDMGQSPATVYRILVTLEGRGLVEFDTEEQLWHIGAQAFVIGARFLRRTSLVDRARPILRRLMEVTGETANLGIEKEGHVLFVSQVETHASIRAFFPPGSLSQMHASGIGKALLAQMEASRLDRLLAATRLEVFTDHTITDGDALKQDLAAIRTQGFAVDNEEKNAGMRCIAAPVFDMNREAVAGISVSGPTSRISEQEIAELSRPVIEAAEQLTQAIGGVAPVAHKGGDP

SEQ ID NO: 791 - protein, 269 aa, Rhizobium leguminosarum CGMCC 1.2553T
MTVPVRRRGRPKGFNDPQTQNVVQSLDRALDVLEALASPEGMTLSELAKHLDQSAATMHRVLATLERRDYVEMSPDGQIFHIGPEAYRLGAAFLRRTNVIERSRPVMRELMLETGETSNLGIEQNGKVLFVSQVETHESIRAFFPPGTLSPLHASGIGKALLSTYDEERLSVLFKGAALQRFTANTLRTINQLKDELEITRQRGYAFDDEEKAVGMRCVAAPVLNIHGEAVAGISVSGPAHRISDRQVKRIGQRVIEAARLVSNRLGAS

SEQ ID NO: 792 - protein, 282 aa, Sulfitobacter sp. HI0021
MESQDNGSGTGRKARGRPRGWTDKTAQNTIKSLDRAMEVFEYLSEAQGKPLSKLADEMRQSPATVYRILVTLEGRGLVEFDHEEQVWYIGPRAFVIGARFLRRTSLVDRARPIMRKLMETTGETANIGVGKEEAVLFLSQVETHANIRAFFPPGSLSPMHASGIGKALLAYMDPERLDKLLSKGQMTRFTAHTIIDPTALRQNLEAIRESGFSVDNEERNEGMRCIAAPVFDMNGEAVAGISISGPTSRVGASEVEELSRPVIKAAHQLSFAIGGSVTRPQP

SEQ ID NO: 793 - protein, 282 aa, Sulfitobacter sp. HI0076; identical to SEQ ID NO: 792

SEQ ID NO: 794 - protein, 261 aa, Thalassobius mediterraneus CECT 5118; identical to SEQ ID NO: 634

SEQ ID NO: 795 - protein, 278 aa, Thalassobius mediterraneus CECT 5118; identical to SEQ ID NO: 633

SEQ ID NO: 796 - protein, 273 aa, uncultured Rhodobacteriaceae sp. PT6CLA
MVEIQRKPRGRPKSPFTDGSGGTIQALDRALAILSALAQQDHASLTDLSEDLAIPTATTHRILATLQQNGYAELDESTQTWAVGVEAYRTGSAYLNRTNLADVSRPAMRALMQDTGETANLAVPDGAAVVFVGQIETQNPIRAFFAAGTRTPMHASGTGKAILAHLPATRQARLLSQIDLTVFTDQTLATLAELQADLASTQARGWSFDQEERHLGMSCIGAPIYDARGEVVAGVSISGPSTRFSDRRVDAFGTRVAQAAAEITDGIGGRLPG

SEQ ID NO: 797 - protein, 269 aa, Sinorhizobium terangae WSM1721
MQVVKRRRGRPKAFNAPESPSVIQSLDRALDVLEALASPEGLTLSELAAHLGQSVATMHRVLSTLERREFVEISPDRQVWHIGPEAYRLGSAFLRRTNVVERSRPIMRELMLETGETSNLGIEKDGHVLFISQVETHESIRAFFPPGTLSPLHASGIGKALLSTYDDSRLTSLFKKRTLERFTENTVRSIAQLEEELRVTRDRGYAFDDEERTKGMRCVAAPILNVHGEAVAGISVSGPTHRMPDRQVQKIGERVRNAATKVSRRLGAP

SEQ ID NO: 798 - protein, 273 aa, Sinorhizobium terangae WSM1721
MEASGKGRRGRKAGENAAPSSVQVLDRSLTLFSLVADRDGSTLTDLADQTGLAPSTIHRLLTSLASHGMVAHDPDTGEWTIGVRAFEIGNAFLRFRKLGTISRPFLKRLMDESGETANIGIEDDGDVVFISQIESHAPMRAFFRPGRRGPIHASGIGKAILSTWSDTEIAKGLSGRTLTRFTRRTLDTLPALIKNVQEIRNRGWSVDDEEHTLGMRCIAAPLFNEYGEAIGGISISGPTVRIDDDKLEVLGPVVRLTADELTRAIGGHRPGEG

SEQ ID NO: 799 - protein, 273 aa, Ruegeria sp. TW15; identical to SEQ ID NO: 716

SEQ ID NO: 800 - protein, 276 aa, Rhizobium sp. BR816
MAIVSEQTKGKRGRKAGANATPSSVQVLDRSLALFSLVADRDGSTLTDLADETGLAPSTIHRLLTSLSSHGMVAHDPDTGEWTIGVRAFEIGNAFLRFRKLGTISRPYLKRLMDESGETANIGIEDDGDVVFISQVESHAPMRAFFRPGRRGPSHASGIGKAILSTWSDTEIAKTLGGRTLTHFTDRTLDTLPALIRDIQEIRNRGWSIDDEEHTLGMRCIAAPLFNEYGEAIGGISISGPSVRIDDKKLDPLGSLVRRTADELTRAIGGHRPGEG

SEQ ID NO: 801 - protein, 269 aa, Rhizobium sp. BR816
MQPAKRRRGRPKGFNAPESPSVIQSLDRALDVLEALASPEGLTLSELAAHLSQSAATMHRVLSTLERREFVEISPDRQVWHIGPEAYRLGSAFLRRTNVVERSRPIMRELMLETGETSNLGIEKDGNVLFISQVETHESIRAFFPPGTLSPLHASGIGKALLSTYDDSRLASLFKKTTLERFTANTVRSIVQLEEELRVTKDRGYALDDEERTKGMRCVAAPILNVHGEAVAGISVSGPTHRMPDRQVQQIGERVRNAAKMVSRRLGAP

SEQ ID NO: 802 - protein, 279 aa, Paracoccus pantotrophus J40; identical to SEQ ID NO: 645

SEQ ID NO: 803 - protein, 284 aa, Marinovum algicola DG 898
MVLMDSQDNGGKRGPRRARGRPRGWEDKTAQNTIKSLDRAMEVFEYLSAAQGRSLTALASETRQAPATVYRILVTLEGRGLVEFDAEDQTWHIGPRAYVIGARFLRRTSLVDRARPYLRRLMEDTGETANLGIEQDGAVLFLSQVETHASIRAFFPPGTLSPMHSSGIGKALLAQMDDARLGRFLAATRLEVFTDHTITDREALRADLREVRARGFSIDNEEKNAGMRCIAAPVFDLNGEAIAGISVSGPTSRVSMAEVDRLSRPVIAAARDLTHAIGGMMREV

SEQ ID NO: 804 - protein, 284 aa, Labrenzia alexandrii DFL-11
MPERENDLIAGRKARGRPRAWDDKSGQNTIKSLDRAMAVFEHLSTQSGVSLSALSDQTGESTATLYRILFTLETRGLVEFDQAQQLWHIGPSAFIVGARFLRRTSLVERARPILRELMEKTGETANLGIQKGDQVLFVSQVETHASIRAFFPPGSLSPLHASGIGKALLAFMPETLCEKILKSSKRERFTSYTLCDAGLLKADLAQAQTRGYSIDGEEKNLGMRCIAAPVFNHYGEIAAGLSISGPTSRVTENKIQSLGSAVMNAAGTLTSALGGEPPIETSDQ

SEQ ID NO: 805 - protein, 163 aa, Methylobacterium sp. 285MFTsu5.1
MRDLMMATGETSNLGIERNGEVLFVSQVESHETIRAFFPPGASSPLHASGIGKALLSGFDEERFESFVRRTHLTSFTDKTIVNADRLREAVRQIRRQGYSFDDEERTTGMRCVAAFISNGYGEAVAGISISGPTPRLPDDRIREIGARVVEAAREVSRRLGAE

SEQ ID NO: 806 - protein, 286 aa, Methylobacterium sp. 285MFTsu5.1; identical to SEQ ID NO: 655

SEQ ID NO: 807 - protein, 282 aa, Methylobacterium sp. EUR3 AL-11; identical to SEQ ID NO: 638

SEQ ID NO: 808 - protein, 280 aa, Paracoccus yeei ATCC BAA-599
MTELRKKGRPRGRAGDSGDSGGIRALDRALDILDAIAAGNGLTLTEIGQRLQMAPSTVHRVLVTLAARGVAEQDASSQAWHVGPTAFRHGSAFMRRSGLVERARPVLRRLMETTGETANLGILNGDAVLFLSQAETHETIRAFFPPGTRSPLHASGIGKALLAHARPQELRAMIRGLRLERFTPHTLSEPEQLAEDLVRIRARGYSLDNEERTLGMRCIAAPIFDLAGEAAAGISVSGPVHRMSDDRLAEITGAVVAAGRELSLGLGPGQGSGRGTEAKP

SEQ ID NO: 809 - protein, 282 aa, Defluviimonas sp. 20V17; identical to SEQ ID NO: 627

SEQ ID NO: 810 - protein, 276 aa, Sphingomonas sp. DC-6
MQQPVRRRGRPKSAKADAQAPGIQSLDRALDVLEALAQHEGITLTELAVHLDQSPATMHRVLATLEQRKYVESNPDKQEWFIGSETFRLGSAFLRRTNIVERSRPVMRDLMARTGETSNLGIERDGDVLFVSQIETHETIRAFFPPGTRSPLHASGIGKALLSAFSDERLEIFLGSGKFTRFTDKTIANAKQLREAIEETRRRGYSFDDEERTIGMRCVAASIINGYGEAVAGISVSGPTIRMPDKRVREIGQLVSEAADEISRQLGSPAHAENPA

SEQ ID NO: 811 - protein, 280 aa, AP Rhodobacteraceae bacterium bin18
MPDDFPTESTGRAVRGRGRPKAWDDRSAQNTIKSLDRAMAVFEHLSTTTGATLSELAADTDQSPATTYRILVTLEARGLVEFDAGPQLWHIGPRAFLIGARYLHRTSLVERARPVLRRLMERTGETANLGIARDGHVLFISQVETHASIRAFFPPGTLSPMHASGIGKALLAQMTPEARARALAEAGLERFTARTLTDPAQIEADMVLTQARGYAIDDEEKTEGMRCIAAPVTDLHGEVVAGISVSGPASRVSDAEIPRLAAAVTEAAATLSAALGAPAA

SEQ ID NO: 812 - protein, 269 aa, Paracoccus sulfuroxidans CGMCC 1.5364
MREVRKRGRPKNVGTPDEAGGVKALERALDVLDLLAASNGLTLTEIAKALGTAPSTIHRVLTTLDARGVAESDPITQAWHIGPSAFRHGTAFMRRSSIVERARPIMRRLMEATGETANLGILNGDAVLFLSQVETHETIRAFFPPGTRSPFHASGIGKALLAHAKPDVLRQILDDAVLSRFTDKTLTERDALLADLEVTRTRGYSFDDEERTLGMRCIAAPVYDLAGEAVAGISVSGPMHRMTEDRCGKIAEAVMVAAQDLSLGIPSRS

SEQ ID NO: 813 - protein, 280 aa, Yangia pacifica DSM 26894
MDSPKDAETSPRRARGRPRGWEDNSAQNTIKSLDRAMAVLDYLSAHPGLTLSELAGDLKQSPATVYRILVTLEGRRLVEFDSAEQLWHIGPQAFVIGARFLRRTSLVERARPVLRGLMEETGETANLGIVREASVLFVSQVETHESIRAFFPPGTLSPLHASGIGKALLAEMAGERLEKLLARKMERFTAHTLAEPEALRADLSAIRARGYSIDAEEKTLGMRCIAAAVFDASGEAVAGISVSGPTIRMREDMTDTTSRAVMRAAQELTAAIGGVTPPVR

SEQ ID NO: 814 - protein, 279 aa, Shimia haliotis DSM 28453
MDFPKNEPASPRKTRGRPRGWDDKTAQNTIKSLDRAMQVFEYLSEEQGKALSQLAEEMGQAPATVYRVLVTLEGRGLVEFDRYEQVWHIGPRAFVIGARFLRRTSLVDRARPIMRRLMEETGETANLGVEREGAVLFLSQVETHASIRAFFPPGTLSQMHASGIGKALLAHMDAGRLDRVFSSDVPKKFTEFTITDLSDLQTDLAGIRDRGYSVDNEEKNLGMRCIAAPVFDQNREAVAGISVSGPTSRVSPEEVERLSRPVVDAAHALTAAIGGEVVA

SEQ ID NO: 815 - protein, 261 aa, Hasllibacter halocynthiae DSM 29318
MSNARGRPRGWQEGERVKSLDRALGVLAALAGRPGLGLSELGRQLGQAPATLHRILGTLAAHGMAEMDADQGWHVGPAAFRIGSAFLRRTSLVERAQPVLRALMRETGETANLGVVRDGHVLFLAQAETHAAIRAFFPPGTLSPLHASGIGKAVLAALPPERRLAALGDTLDGFTPHTLTAPDALGADLATAAARGWAIDAEERHEGMRCIACAVRDPSGAPVAGLSVSGPAARMLSAGEERIGRAVVARAQELSASLGTG

SEQ ID NO: 816 - protein, 280 aa, Oceanicola nitratireducens DSM 29619; identical to SEQ ID NO: 702

SEQ ID NO: 817 - protein, 273 aa, Ruegeria halocynthiae DSM 27839
MESQKRPRGRPKSLFKESSAGTMQALDRALGVLTTVAQLERVVLSDLAREVDIPTATTHRILVTLQKHGFVSFDEERQEWMVGIEAYRTGASFLRRNNILEIGRPILRRLMLDSGETANLAVPDGPEVVFVGQVETQNPIRAFFPPGARTPMYASGTGKAILAALSEDSLNKVLGQTDLIAFTENTNLPHAGLQEDLAETRARGWSYDHEERYEGMSCIGAAIFNDRGEPCAGISVSGPTVRFDRERAPELGALVRNAAQEITHLSGGRSPGG

SEQ ID NO: 818 - protein, 280 aa, Citreimonas salinaria DSM 26880
MATAEDGTGQRRARGRPRAWSDTTEQNRIKSLDRAIGVLERLSELGGATLSDLAEATDHAPASLYRILVTLESRGMVDFDPVPQTWHIGPSAFRIGSRFLRRTSLVERARPVLRTLMEATGETANLGIAREGHVLFVSQVETHESIRAFFPPGTMSPMHASGIGKALLAQLPPERAAHIAAKHGLTRFTGRTLTAPEALAADLAQTRRRGYAIDDQEKTRGMRCIAAPIFDMHDEAVAGLSISGPADRLPDDAIPDIGAKVIEAAASVSRGLGAGRVASV

SEQ ID NO: 819 - protein, 279 aa, Ruegeria mobilis S1942
MDSQENAPKATRRARGRPRDWHDKTAQNTIKSLDRAMEVFEFLSEAQGKPLTMIAEEMGQSPATVYRILVTLEGRGLVEFDTEEQLWHIGARAFVIGARFLRRTSLVDRARPILRKLMEETGETANLGIEKEGHVLFLSQVETHASIRAFFPPGTLSQMHTSGIGKALLAQMESSRLDRLLATTRLEAFTDHTITDHEALKQDLATIRAQGFAVDNEEKNAGMRCIAAPVFDMNREAIAGISVSGPTSRISAQEISQLSRPVIEAARALTLAIGGDVTP

SEQ ID NO: 820 - protein, 277 aa, Leisingera aquaemixtae CECT 8399
MPQAPRRKGRPKNFDSASNPPTIQSLDRALDVLDALAGASGMTLTELSTALDQSAATMYRVLATLEARQIVEMEPQSQTWHIGAMAFRLGSAFLRRSSVIERARPVMRELMEATGETSNLGIERGGDVMFVSQVETYESIRAFFPPGTTSPMHASGIGKALLSCFGEDQLARFLRGSALQDFTEKTLTSADALREDLAQIRRRGWSFDDEEKAPGMRCVAAPVFGMQGEVLAGISVSGPTSRMPDARISEIGALVRGAAEKLSYGLGAPAADQAAPG

SEQ ID NO: 821 - protein, 277 aa, Leisingera aquaemixtae CECT 8399; identical to SEQ ID NO: 820

SEQ ID NO: 822 - protein, 281 aa, Paracoccus halophilus JCM 14014; identical to SEQ ID NO: 697

SEQ ID NO: 823 - protein, 246 aa, Ruegeria sp. ZGT118
MEVFEHLSEAQGKTLSTISAETGQAPATVYRILVTLEGRGLVEFDHKEQIWHIGPQAFVIGSRFLRRTSLVDRARPILRKLMEVTGETANLGVEKEGAVLFLSQVETHASIRAFFPPGTLSPMHASGIGKALLAYMDTERLDRVLASAELQAFTERSITAPDALRADLARIRARGYSVDNEEKNAGMRCIAAPVFDATREAVAGISVSGPTSRVSESEIDRLSRPVIEAAQRLTQAIGGTFNDPRT

SEQ ID NO: 824 - protein, 280 aa, Ruegeria faecimaris DSM 28009
METQKRPRGRPKSLFKESSAGTMQSLDRALSVLTTVASLERAALSDLAREVDVPTATTHRILVTLQKHGFVAFDEERQEWMIGIETYRTGASFLRRNGVIEIGRPILRRLMQDSGETANLAVPDGAEVVFVGQVETANPIRAFFPPGARTPMYASGTGKAILAALNEAALIKALGTLDTKVFTPQTLVHGDGLQSDLNQTRARGWSHDREERYEGMSCIGAAIFNDRGEPCAGISVSGPTARFSTERAPELGRLVQAAAQEVTLLSGGRLPARDAGDAGL

SEQ ID NO: 825 - protein, 280 aa, Shimia sagamensis DSM 29734
MVSQRNDKNDGPKARGRPRDWHDKTAQNTIKSLDRAMEVFEFLSEEQGKTLSQIADEMGQSPATVYRILVTLETRGLVEFEGREQLWHIGPRAFIIGARFLRRTSLVDRARPVMRKLMELTGETANLGVEREGQVLFLSQVETHASIRAFFPPGTLSQMHASGIGKALLAHMEAGRRNRLLASEQLTEFTERTITDVDALLEDLLVIRERGYSVDDEERNMGMRCIAAPVFDFNGEAVAGISVSGPTSRVSPEETEKLARAVVSAAKELTLAIGGEIAAS

SEQ ID NO: 826 - protein, 282 aa, Sulfitobacter sp. HI0027; identical to SEQ ID NO: 792

SEQ ID NO: 827 - protein, 277 aa, Rhodobacterales bacterium Y4I scf_1106129324775 genomic scaffold
MPQAPRRKGRPKNFDSASNPPTIQSLDRALDVLDALAGASGMTLTELSTALDQSAATMYRVLATLEARQIVEMEPQSQTWHIGAMAFRLGSAFLRRSSVIERARPVMRELMEATGETSNLGIERGGDVMFVSQVETYESIRAFFPPGTTSPMHASGIGKALLSCFGEDQLTRFLRGRTLKEFTEKTLTSAEALREDLAQIRRRGWSFDDEEKAPGMRCVAAPVFGMQGEVLAGISVSGPTSRMPDTRISEIGALVRGAAEKLSYGLGAPAADQAAPG

SEQ ID NO: 828 - protein, 272 aa, cNanh_4411
MKPTARRKGRPKAFDSKPTQTTIQSLDRALEVLDTLALENGMTLTEVSDRLKQSPATMYRVLSTLQARGFVEIDAAAQTWHIGAMAFRLGSAFLRRSGVVDRSRPVMRDLMEATGETSNLGIERDGEVMFIGQVETTETIRAFFPPGTLSPMHASGIGKALLSQRDADSLGRFLRTYPLNRFTDKTIGTAPALQAELTAIRQQGYAFDDEERTAGMRCVAAPILNLYGEAIAGISVSGPTHRMPADRIREIGRLVQQAANTVSRGLGAPEDT

SEQ ID NO: 829 - protein, 279 aa, Methylobacterium mesophilicum SR1.6/6
MDSGSRRRGRPKGFGGAKPSATIQALDRALDVLDVLADGDGLTLSELAGTLGQSVATMHRVLATLERRGLVEISADKQEWHVGADAYRLGSAFLRRHNVVERSRSMMWTLMQETGETSNLGVEKDGNVLFVSQVETHETIRAFFPPGSLSPLHASGIGKALLSTYAPARTERLFRGKTFARFTDKTIASLDQLRDDVEATRRRGYAIDDEERTIGMRCVAAPILNFHGEAIAGISVSGPTHRLSDAQLQAIGERVRKGAAAVSRALGAPAEAPDAGDRD

SEQ ID NO: 830 - protein, 272 aa, Methylobacterium sp. B34
MDSGNRRRGRPKGFGGAKPAATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGKTFARFTDKTIGSLDQLRDDVEATRRRGYAIDDEERSIGMRCVAAPILNVHGEAIAGISVSGPTHRLSDEKLRAIASGCGEAPLRSRAPSARPPRR

SEQ ID NO: 831 - protein, 278 aa, Roseivivax halodurans JCM 10272
MGEEATPRMRRTRGRPRGWRDNRGEYMIKSLDRAMEVLQYVSAHQGLTLSDLAAGLGQAPATVYRTLVTLEGRGLVEFDRDLQTWSMGAQAFVIGAQFLRRTSIVERAKPILRRLMEATGETANLGMVRERSVLFVSQAETHAPIRAFFPPGTLSPLHASGIGKALLAHMPQERFDAFLSVPLPGFTASTLTTRAALLTDCDLTRERGYAVDEEEKTEGMFCVAAPVFDASGDAAAGISVSGPVARFGRDRIANIAVHVVGAAQSLSAAIGAPSSYRA

SEQ ID NO: 832 - protein, 275 aa, Pelagicola litoralis DSM 18290
MPPPIRNKGRPKAFNTDTTANPIQSLDRALVVLETLAQSNGMTLSEIASHLDQSVATMYRVLSTLAARGFVENDPQTQAWHIGPMSFRLGSAFLRRSSVVERARPVMRDLMQATGETANLGIEKDGHVMFLSQVETHESIRAFFPPGTLSPMHASGIGKALLSCYSDDALSWFLRTHARESFTEHTLCDPETLRAEMQNARHLGYAVDDEEKNLGMRCVAAPIFNFYGEAVAGISVSGPISRLTQERVAQVGADVKSAAESLSRGLGAEPDAPQS

SEQ ID NO: 833 - protein, 272 aa, Thalassobacter stenotrophicus DSM 16310
MKSKRGRPKAFHDTTEQNTIQSLDRALHVVNYVAQSPDRSLTEIATALEQSPATVYRVLVTLAGHQMVEMDPAEQTWHIGAGAFRLGSAFLRRSSLVERARPVMRHLMERTGETANIGIEKNGRVLFLGQVETHESIRAFFPPGTQAPMHTSGIGKAILSHFGPDRVHKIFESEAETYFTAHSLGTLDALTDDLALTRTRGFAVDNEERTLGMRCIAAPIFNSEGEAIAGLSISGPVVRISQDRVPEISRAVTEAAHKLTEAIGGPAMPVES

SEQ ID NO: 834 - protein, 286 aa, Methylobacterium sp. UNC300MFChir4.1; identical to SEQ ID NO: 766

SEQ ID NO: 835 - protein, 279 aa, Paracoccus pantotrophus DSM 1403
MSVQIRKRGRPRGRAGGLGAEDSGGIRALDRALDILDLIAVSSGLTLTEIAQRLEMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPADLKRMIREMRLERFTEMTLTDPQALLDDLARIRARGYALDNEERTPGMRCIAAPIFDLAGEAAAGISVSGPSLRMSDARLEAMSEAVIEAARELSLGMAPHAGAGEGR

SEQ ID NO: 836 - protein, 269 aa, Rhizobium lusitanum P1-7; identical to SEQ ID NO: 694

SEQ ID NO: 837 - protein, 256 aa, Paracoccus alkenifer DSM 11593
MAENGVQSVARALSLMRLLAQEDGGSRLSDVARAAGLPVSTAHRLLTTLEQQGFAQFEPASSLWHVGRDAFTVGLAYGRRLSFVAPALPLLRRLRDATRETANLGILDDDHLVTVSQVESREIRRALSPPGRRVPVFSSAMGKAILATWRDQEVLALADRAGLPPLTTKSLRSREAALAEIARTRARGWALDDEEFNLGMRCLAAVVWSPQGEAACAISISGAAVRLTEDRLEPLGALVAQAAEELTGVLGGVAPG

SEQ ID NO: 838 - protein, 276 aa, Paracoccus alkenifer DSM 11593
MESTSTRPRGRPSSGGPAAGSAVVDRALALLEVLAAGDGATLSELGRRLGLAPSTTHRLLAALAARRLVEADPLTQLWHVGPGAFRLGAAFLRRGGLAERARPLMAQLAADSGETAVLAVADGDAALVVAESQAAGSLRVVLPPGARLAYHATAPGKALIAHLPLARVRALLGQGALPALTPRSFTDQGELTAELATLRHGGWLAERGESVPGQSGIAAPVFGGSGDPVAALGIIGPSVRLDDAALARLGPAVAAAAAGLGAALGGPALSPQTGKR

SEQ ID NO: 839 - protein, 299 aa, Paracoccus alkenifer DSM 11593
MQQPVRRRGRPRNSPSDAQATGIQSLNRALDVLEALARHEGITLTELAAHLDESPSTMYRVLATLEQRRYVESNPDKQEWFIAAEAFRLGSAFLRRTNIVERSRPVMRDLMARTGETSNLGIERDGDVLFVSQVETHETIRAFFPPGTRSPLHASGIGKALLGAFAEERLAGFLRTASFTRFTDRTVADAGQMQADIARTRSRGYAFDDEERTVGMRCVAAAIINGHGEAVAGISVSGPTIRMPDQRVREIGGLVAMAAAEVSRLLGAPTPAPAAPAPATDAPAVTPAVTPAVTPPVQG

SEQ ID NO: 840 - protein, 275 aa, Loktanella koreensis DSM 17925
MSDSPDQNTRARGRPRGWTDNTEQNTIKSLDRAMVVLERLSELESATLSQLASDLGQAPASIYRVLVTLQGRGIVGYETDGQIWHVGPTAYLIGSRFLRRTSLVERARPVLRRLMEQTGETANLGIRREGYVLFVSQVETHATIRAFFPPGTMSPMHASGIGKALLAYMPQDQRDRLLDGTELTQFTQFTCANRSDLESDLTHIRARGYSIDAEEKNLGMRCIAVPIFDVFGEAVAGISVSGPTSRVRVELTEDLATHVKSAGAELTHALGGTLP

SEQ ID NO: 841 - protein, 286 aa, Methylobacterium sp. 190MF; identical to SEQ ID NO: 655

SEQ ID NO: 842 - protein, 277 aa, Ruegeria sp. ANG-S4
MSQQDAAIRRGRPRQKTNGEVSAASPVSALDRGIRLLIALADTRGAALAELARSTEIPVATAHRLLTTLQHRGMVVHDASQGKWRIGPQAYRIGSTFEEEANLLEVAPPVMRILSKETGETANLAIEEGGQLLYLIQVESENPIRASIKNGTDAYFHTSGVGKAIMAHLDTASLKRLLDPLTLVSQTPNSITEKQRLMAELDMSRQRGWALDDEERSAGMRCIGAPVFDSLENVVAGVSISGPITRFPDDKLESLAASVVAAANSITNRLRNTPAGS

SEQ ID NO: 843 - protein, 272 aa, Ruegeria sp. ANG-S4
MEPPKRPRGRPKSLFKESSAGTMQSLDRALGVLTAVGEVERAALSDLSRATGVPTATTHRILSTLQKHGFVAFDDERQEWMIGIEAYRTGASFLRRSSVLEVGRPILRRLMRQSGETANLAVPDGAEVVFIGQVETQNPIRAFFPPGARTPMYASGTGKAILSALDETAVTTLMTRLDPVAFTEHTRLPGDDLLEDLAKTRARGWSHDREERYYGMSCIGAAIFDNKAEPCAGVSVSGPTVRFGPDRAPELAALVTQAASEITELSGGQLPP

SEQ ID NO: 844 - protein, 272 aa, Leisingera nanhaiensis CGMCC 1.10959; identical to SEQ ID NO: 828

SEQ ID NO: 845 - protein, 275 aa, Loktanella rosea DSM 29591
MEEEVKRGRGRPKAWDDKGAQNTIKSLDRALEVLVQLGEMQGSTLSEIAGALGQSPATVYRVLTTFQGRGFADFDPQSQVWSIGPAAFLTGSMFLRRTSLVERARPIMRDLMEATGETANLGIERDGQVLFLGQVETHATIRAFFPPGTASAMHSSGIGKALLSRMDDKRQRAVLAAGKLEQFTPHTLTDPEAMIADLHTTKARGYAFDGEERNIGMRCIAAPVYNVFGEAVAGISVSGPTSRITDDRIAALAEDVMEAAARLTRAIGGNNRPAS

SEQ ID NO: 846 - protein, 281 aa, Poseidonocella pacifica DSM 29316
MSTTLDDRKGERRGRGRPRGPAAATGSIQALDRALSVLQSLAAQGRVKLTDLALEVGIPTATAYRILTTLHSRGFVDFEEATQSWKVGLEAYRTGSAYLVQTQLVDAARPAMRDLMEESGETANLAIPDGGEVVFIGQVETRNPIRAFFQPGTRTKMHASGTGKAILAAMSEAQVVQILTRQGLPQFTETTLVTKDALFADLHLTRERGWSFDRDERHVGMSCIGAPIFNNRGDVRAGISISGPSARFDDGNIPLLGRRVRTAADWITQITGGTPPEIPAP

SEQ ID NO: 847 - protein, 271 aa, Leisingera sp. ANG-S5; identical to SEQ ID NO: 624

SEQ ID NO: 848 - protein, 272 aa, Cribrihabitans marinus DSM 29340
MPDPTPRKGRPRAFAGPGSQPTIQALDRALTVLDALAAADGLTLTELSRSLDQSTATVHRILATLEARQVVEMDMQQQAWHIGAMAFRLGSAFLRRMSVIDRSRAAMRALMQDTGETSNLGIERNGEVMFVSQVETQESIRAFFPPGTLSPMHASGIGKALLSRYPEDRLERFLRRRVLQRFNAQTITDPGALKTDLAQVRARGWALDDEEKAAGMRCVAAPIVDIHGEAVAGISVSGPTQRMPPARIEEIGALVRGAAAEVSRGLGAPLSD

SEQ ID NO: 849 - protein, 279 aa, Ruegeria mobilis DSM 23403
MDSQENAPKATRRARGRPRDWHDKTAQNTIKSLDRAMEVFEFLSEAQGKPLTMIAEEMGQSPATVYRILVTLEGRGLVEFDTEEQLWHIGARAFVIGARFLRRTSLVDRARPILRKLMEETGETANLGIEKEGHVLFLSQVETHASIRAFFPPGTLSQMHASGIGKALLAQMDVGRLDRLLATTRLEVFTDHTITDHEALKQDLTAIRAQGFAVDNEEKNAGMRCIAAPVFDMNREAIAGISVSGPTSRISAQEITQLSRPVIEAAHALTLAIGGDVAS

SEQ ID NO: 850 - protein, 275 aa, Pseudopelagicola gijangensis DSM 100564
MQPPLRKKGRPKAFNSDAAANPIQSLDRALIVLETLAGHSGLTLSEIAEKLDQSAATMYRVLTTLAARGFVESEPQTQEWHIGPASFRLGSAFLRRSSVVERARPVMRTLMEATGETANLGIEKDNMVMFVSQVETHESIRAFFPPGTLSQMHASGIGKALLSLFPERRLERFLREQTLTDFTEKTLSDPDAIRAEMARSRAQGFAVDDEEKNLGMRCVAAPITNFYGEAVAGISVSGPVSRMTSDRIPEVAALVKAAAGELSQGLGADTPNPEK

SEQ ID NO: 851 - protein, 273 aa, Ruegeria atlantica CECT 4293
MDNQKRPRGRPKSLFKESSAGTMQSLDRALGVLTTVARLERAALSDLAREIDVPTATTHRILVTLQKHGFVAFDDERQEWMIGIEAYRTGASFLRRNSVLEIGRPILRRLMQDSGETANLAVPDGSEVVFVGQVETPNPIRAFFPPGARTPMYASGTGKAILAAMTETGLAKTLGAIDPVEFTANTQIPGDGLQQDLAKTRTRGWSHDREERYQGMSCIGSAIFNDRGEPCAGISVSGPTARFGVDRAHVLGELVLAAAQEITHLSGGQTPKT

SEQ ID NO: 852 - protein, 277 aa, Ruegeria atlantica CECT 4293
MNETKKPLRRGRPRLKANEEKAEVSLVVALDRGIQVLICLADRRCATLAELAKITAIPAATAHRLLTTLQQRGMVIHDAEKGKWRIGPQSYRIGSTFEEGSNLLEVAPAVMRLLSEETGETANLAVEEGGLLLFLVQVESENPIRASFKNGTAAHFHTSGVGKAIMAFMNEAALESFLTPQILVQQTPNSITDAQELKAELCKTRERGWALDDEERFLGMRCIAAPIFDSLGKVVAGVSVSGPIARFPDHKLEGLATLVVKAAATISDKLTHSSAGS

SEQ ID NO: 853 - protein, 272 aa, Thalassobacter stenotrophicus CECT 5294; identical to SEQ ID NO: 833

SEQ ID NO: 854 - protein, 281 aa, Loktanella sediminilitoris DSM 29955
MESHENENPGARRARGRPRGWDDKTAQNTIKSLDRAMEVYEFLSEAQGKALTTISTEMGQSPATVYRVLVTLEGRGLVEFDPVEQVWHIGPQAFVIGARFLRRTSLVDRARPILRKLMEQTGETANLGIEKEGAVLFLSQVETHASIRAFFPPGTLSPMYASGIGKALLAEMDDDRLARAMAFQELSAFTPFTITDADALRADLAQVRANGFSVDGEEKNLGMRCIAAPVFDVNAEAIAGISVSGPTSRVSPDDIDRLSAFVKDAAHALSLAIGGQADGRS

SEQ ID NO: 855 - protein, 269 aa, Rhizobium taibaishanense DSM 100021T
MPVEMRKRGRPKAFNGPQSQNTIQALDRALDVLEALATPEGMTLSKLADHLGQSTATMHRVLATLERREFVEISPDRQVWHIGPEAYRLGSAFLRRSNVVERSRPIMRELMLETGETSNLGIEKGGHVLFISQVETHESIRAFFPPGTLSPLHASGIGKALLSTYDGDRLTALFKTRELERFTENTVRSLDQLKEELQRTRERGYAFDDEERTWGMRCVAAPILNVHGEAVAGISVSGPKIRLQDADVHQIGERVRRAASMVSRRIGAP

SEQ ID NO: 856 - protein, 279 aa, Rhizobium taibaishanense DSM 100021T
MEKQCVKESGSVQSIHRALSILERLSASDEGLTLKEVAAQVSLPPSSAHRILTTLQRQRFVRFDQATMCWSIGVQAFLVGNAFSRSRDMVALSIPFMRRLMLASGETVNFFMLDGSEVVCMAQVQSQQMVRAISRPGGGAEMHRSAAGKMILAHMSDEEVAAIITRKGMARYTDHTITTQEALIQELARIRERGFSVDNEEFFTGLRCIAAPIYDETGSVYAAVSIAGPTSRITEARTQAMGELVEICARSITSEFGGSPTASKSRPGHSLHYPTARLS

SEQ ID NO: 857 - protein, 282 aa, Rhodobacteraceae bacterium JGI 01_L11_4000m (contamination screened)
MDSQENGSGAARRARGRPRGWTDKTAQNTIKSLDRAMEVFEYLSEAQGKPLTKLADEMRQSPATVYRILVTLEGRGLVEFDHEEQVWYVGPRAFVIGARFLRRTSLVDRARPIMRKLMETTGETANIGKGQEDAVLFLSQVETHANIRAFFPPGSLSPMHASGIGKALLAYMEPERLDKLLSKGQMTRFTAHTIVDPAALRQNLEAIRESGFSVDNEERNEGMRCIAAPVFDMNGEAVAGISISGPTSRVGASEVEELSRPVIKAAHELSLAIGGDVTRPQP

SEQ ID NO: 858 - protein, 246 aa, Sulfitobacter sp. HI0054
MEVFEYLSEAQGKPLTKLADEMRQSPATVYRILVTLEGRGLVEFDHEEQVWYVGPRAFVIGARFLRRTSLVDRARPIMRKLMETTGETANIGKGQEDAVLFLSQVETHANIRAFFPPGSLSPMHASGIGKALLAYMEPERLDKLLSKGQMTRFTAHTIVDPAALRQNLEAIRESGFSVDNEERNEGMRCIAAPVFDMNGEAVAGISISGPTSRVGASEVEELSRPVIKAAHELSLAIGGDVTRPQP

SEQ ID NO: 859 - protein, 304 aa, Labrenzia aggregata CECT 4801
MLYFSYGELIFQNQKNELMTDLKSDSSATRRARGRPRAWDDKTEQNTIKSLDRAMAVFEHLSTQSGVSLSALSDQLGESTATLYRILFTLETRGLVEFDQAQQLWHIGPGAFIIGARFLRRTSLVERARPVLRSLMEQTGETANLGVAQADQVLFVSQVETHESIRAFFPPGTLSPLHASGIGKALLAFMDEDQCKRILKQTDRERFTEHTLCDAALLATDLEAIRARGFSIDGEEKNLGMRCIAAPVFNHYGEAVAGLSVSGPTSRVSPDSIAPFAEAVKAAAAALTAALGGEIAPPQTKTVG

SEQ ID NO: 860 - protein, 301 aa, Roseobacter sp. SK209-2-6
MPKPCIFHIVKVSFIENQRHLLESQDNPSKSPRRARGRPRDWEDKTAQNTIKSLDRAMMVLEFLSEGQGKPLSELAQDLQQSPATLYRVLTTLEGRGLVEFETETQAWHIGAQAFVIGARFLRRTSLVERARPILRRLMEQTGETANLGVEKGGMVLFLSQVETHESIRAFFPPGTLSQMHASGIGKALLAEMEPSRLERVLKEHPLAEFTTQTITDAGHLRQDLLLIQDRGYAIDDEEKNLGMRCIAAPIFDMHQEAVAGLSVSGPTSRISRDHISEIGAVVIEAAAEVSSAIGGQALRR

SEQ ID NO: 861 - protein, 278 aa, Rhodobacterales bacterium HTCC2083 scf_1106200183017 genomic scaffold
MPKLPDSEIPRTRGRPRAFNEKTEQNTIKSLDRALGVLKELAQIESATLSELATAMKESPATLYRVLTTFALHGIVEMDETAQTWHIGSEAYQIGSAFLRRTSLIDVSRPILRKLMQETGETANLGIEKNGSVFFMSQIETNAPIRAFFPPGTLSEMHASGIGKALLAHMDETQLKRFAARGLQTFTPHTLATPESLAADMVTTRERGYALDDQEKNLGMRCIAAPIQDAYGEVIAGISVSGPTTRVSTDHIETLAKSVMRAAQDVSNALGAKTSEPS

SEQ ID NO: 862 - protein, 278 aa, Agrobacterium sp. ATCC 31749 AGT22
MQQTVRKRGRPKGAKPTQPAASIQALARSLDVLEALASHDGVTLTELSKYLDQSPATLHRILATLENRRYVESNTERQEWFVGPEAFRLGSAFLRRTNIVERSRPVMRDLMARTGETSNLGIERDGDVLFISQVETHDTIRAFFPPGTRSPLHASGIGKALLSAFDDDRLEAFLKTATFTRFTDKTIANIKELRESIQQTRRLGYSVDDEERTIGMRCVAASIVNSYGEAVAGISVSGPTIRMPDKRVREIGQLVSDAANEISLQLGSPLLNLPRHRD

SEQ ID NO: 863 - protein, 276 aa, Paracoccus sp. TRP Paracoccus_TRP_Contig_10; identical to SEQ ID NO: 609

SEQ ID NO: 864 - protein, 277 aa, pAqui_F126
MPQPPRRKGRPKSFDSASQPATIQSLDRALDVLDALAAANGMTLTELSSALGQSAATMYRVLSTLEVRQIVEVEPQSQTWHIGAMAFRLGSAFLRRSSVIERARPVMRELMEATGETSNLGIERGGDVMFVSQVETHESIRAFFPPGTTSPMHASGIGKALLSCFGEDQLTRFLRGQALERFTEKTLTSAEALRADLAQIRSRGWSFDDEEKAPGMRCVAAPVFGMQGEVLAGISISGPTARMPDGGINGIGALVKDAAEKLSYGLGAPAAVETPPG

SEQ ID NO: 865 - protein, 279 aa, Ruegeria mobilis F1926; identical to SEQ ID NO: 819

SEQ ID NO: 866 - protein, 283 aa, Oceanicola sp. HL-35
MESQDNGPGGVRKARGRPRDWHDKTAQNTIKSLDRAMEVFEFLSERQGMALSTISDEMRQSPSTVYRILVTLETRGLVEFDAEEQLWHIGPRAFTIGARFLRRTSLVDRARPAMRRLMEMTGETANLGVEKESAVLFLSQVETHATIRAFFPPGTLSPMHASGIGKALLAQMEEDRLSRWLAGRGRLEAFTERTITDPDRLRQDLKQIRTRGYAIDDEEKNAGMRCIAAPVFDITGEAVAGISVSGPTSRVTREQTESLSRPVMEAARTLTQSIGGVVIPPRS

SEQ ID NO: 867 - protein, 170 aa, Ensifer meliloti Rm41
MQVVKRRRGRPKAFNSPESPSVIQSLDRALDVLEALASPEGLTLSQLAAHLGQSVATMHRVLSTLERREFVEISPDRQVWHIGPEAYRLGSAFLRRTNVVERSRPIMRELMLETGETSNLGIEKDGHVLFISQVETHESIRAFFPPGTLSPLHASGIGKALLSTYDDSRL

SEQ ID NO: 868 - protein, 273 aa, Ensifer meliloti Rm41
MEAKGKGKRGRKAGENAAPASVQVLDRSLSLLAIIAEGDGSTLTALSERSGMAPSTVHRLLTSLAQHEMVANDAEAGTWTVGVKAFEIGNAFLRFRKLGTISRPFLKRLMDESGETANIGIEEDGDVVFISQVESHAPMRAFFRPGRRGPIHASGIGKAILSTWSDTEIAKTLSGRTLACFTGRTLATLPDLIRNVQEIRFRGWSVDDEEHTLGMRCIAAPLFNEYGEAIGGISISGPTVRIDDERLGVLGPAVRRMADELTRAIGGHRPEEG

SEQ ID NO: 869 - protein, 275 aa, Roseovarius sp. MCTG156(2b)
MTQTKRPRGRPKSQFADSSAGTMQALDRALAVLTAVARQEGVNLTDLSLSLGIPTATTHRILTTLQKRDFVRFDEERQDWTIGIEAYRTGVAYLKRTNLADAGRPVMRRLMEQTGETANLAVPDGAEVVFIGQVETQNPIRAFFPPGSRTPMHASGTGKAILAALPEDRLMALLKGAGLKGFTEDTLITPRALFDDLAETRRRGWSFDRNERYDGMSCIGAAIFNDRGEPCAGVSISGPSSRFRDAQIAEFGAAVAQAAAQITHLIAGHGLMPGQ

SEQ ID NO: 870 - protein, 269 aa, Rhizobium rhizogenes OK036
MPGEPRRRGRPKAFNGPQTQNTIQALDRALDVLDALATPEGKTLSELASQLDQSAATMHRVLATLERREFVEISPDRQVWHIGPEAYRLGAAFLRRSNVVERSRPIMRELMLETGETSNLGIEKDGNVLFISQVETHESIRAFFPPGTLSPLHASGIGKALLSTYDEDRLSTLFKKKEFERFTDNTVRSFEQLREELQKTRERGYSFDDEERTKGMRCVAAPILNVHGEAVAGISVSGPIHRLPDADINQIGERVRSAARMVSRRLGAP

SEQ ID NO: 871 - protein, 269 aa, Rhizobium leguminosarum YR374; identical to SEQ ID NO: 763

SEQ ID NO: 872 - protein, 286 aa, Methylobacterium sp. YR668; identical to SEQ ID NO: 655

SEQ ID NO: 873 - protein, 278 aa, Sinorhizobium americanum CCGM7
LAVAVVSEQAKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPYLKRLMDESGETANIGIEDDGDVVFISQVESHAPMRAFFRPGRRGPSHASGIGKAILSTWSDTEIAKTLGGRTLTHFTDRTLDTLPALIRNIQEIRNRGWSIDDEEHTLGMRCIAAPLFNEYGEAIGGISISGPSVRIDDNRLEPLGSLVRRTADELTRAIGGHRPGEG

SEQ ID NO: 874 - protein, 269 aa, Sinorhizobium americanum CCGM7
MQVVKRRRGRPKAFNAPESSNVIQSLDRALDVLEALASPEGLTLSELAAHLGQSAATMHRVLSTLERREFVEISPDQQVWHIGPEAYRLGSAFLRRTNVVERSRPIMRELMLETGETSNLGIEKDGNVLFISQVETHESIRAFFPPGTLSPLHASGIGKALLSTYDDSRLASLFKKTTLERFTANTVRSVAQLEEELRVTRDRGYAFDDEERTKGMRCVAAPILNVHGEAVAGISVSGPTHRMPDRQVQEIGERVRNAAKMVSRRLGAP

SEQ ID NO: 875 - protein, 281 aa, Palleronia marisminoris DSM 26347
MDFQDNAGRGTRKARGRPRDWDDKTAQNTIKALDRAMEVFEFLSERQGMALSAISAEMGQSPSTVYRVLVTLENRGLVEFDAGEQLWHIGPRAFMIGARFLRRTSLVDRARPVMRALMEATGETANLGVEKEGMVLFLSQVETHANIRAFFPPGTLSAMHASGIGKALLAQMDDARLARRLGDGLEAFTKKSIIDYGALLADLRETRTRGYSYDDEERNIGMRCIAAPVFDINGEAIAGISVSGPTSRLTGDGLERLSRPVMEAARTLTEAIGGSITPQRT

SEQ ID NO: 876 - protein, 279 aa, Paracoccus aminovorans DSM 8537
MSLEVRKRGRPRGRAGGPGAEDSGGIRALDRALDILDLIAGSSGLTLSEIGQRLEMAPSTVHRVLVTLAARGVAESDPTTQAWHVGPTAFRHGSAFMRRSGLVERARPLLRRLMEQTGETANLGILNGDAVLFLSQAETYETIRAFFPPGTRSALHASGIGKALLAHVRPGELRLMLAEMRLQRFTDKTLCEPRALQEDLARIRERGYSLDNEERTPGMRCIAAPIFDLAGEAAAGISVSGPTLRMSDARLESMSAAVVAAAKELSLGMAPAGGPMRES

SEQ ID NO: 877 - protein, 280 aa, Yangia pacifica CGMCC 1.3455; identical to SEQ ID NO: 813

SEQ ID NO: 878 - protein, 277 aa, Roseovarius indicus DSM 26383
MPSDTAPDPQNRRARGRPRGWDDKTEQNTIKSLDRAMLVFEHLSRSQGKMLTELADDLNQSPATVYRVLVTLETRGLVEFDPAEQLWHIGPQAFVIGAGFLRRTSLVERARPILRRLMEVTGETANLGRELDGQVLFLSQVETNATIRAFFPPGTLAEMHSSGIGKVLLAQMSEERIARILADHPMQAFTPNTITDPATLSRELATIRAQGFAIDAEERNEGMRCIAAPVFDHSQSAVAGLSVSGPTSRVSEEKTDEFSHAVIQAARDLSAALGGLP

SEQ ID NO: 879 - protein, 274 aa, Jannaschia rubra DSM 16279; identical to SEQ ID NO: 668

SEQ ID NO: 880 - protein, 269 aa, Rhizobium etli bv. phaseoli IE4803
MQNPNRRRGRPKSFNEPQSSSVIQSLDRALDVLEALASPEGMTLSELSAHLDQSPATMHRVLATLERREFVEISPDRQVWFIGPEAYRTGAAFLRRSNVVERSRPIMRELMLETGETSNLGIEKDGNILFISQVETHESIRAFFPPGTLSPLHASGIGKALLSTYDDDRLSALFKTSTLKRFTENTARSVAQLKEELIVSRERGYAIDDEERTKGMRCVAAPILNVHGEAVAGISVSGPTHRMPDRLIRQIGERVTGAAKTVSRRLGGG

SEQ ID NO: 881 - protein, 281 aa, Roseivivax sediminis DSM 26472
MESPENGGRGPRRARGRPRGWDDKTEQNTIKSLDRAMEVFEFLSEAQGKALTAIAGEMGQSPATVYRILVTLEGRGLVEFDAEEQLWHIGPRAFVIGARFLRRTSLVERARPVLRRLMEATGETANLGVGRDASVLFLSQVETEASIRAFFPPGTLSPMHASGIGKALLAHMDEDRLARVLKVAVLTAFTDHTLTDAEALRQDLGVIRTRGYSIDNEEKNAGMRCIAAPIFDMHGEVTAGLSVSGPTSRIGLDQVAPLSGHVLAAAHDLTAAIGGVTPPRN

SEQ ID NO: 882 - protein, 278 aa, Agrobacterium sp. KFB 330
MQQTVRKRGRPKGAKPTQPAASIQALARALDVLEALASHDGVTLTELSNYLDQSPATLHRILATLENRRYVESNTERQEWFVGPEAFRLGSAFLRRTNIVERSRPVMRDLMARTGETSNLGIERDGDVLFISQVETHDTIRAFFPPGTRSPLHASGIGKALLGAFDDDRLEAFLKTATFIRFTDKTIANIKELRESIQQTRRLGYSFDDEERTIGMRCVAASIVNSYGEAVAGISVSGPTIRMPDKRVREIGQLVSDAANEISRQLGSPLLSLPRHRD

SEQ ID NO: 883 - protein, 271 aa, Leisingera sp. ANG-DT; identical to SEQ ID NO: 624

SEQ ID NO: 884 - protein, 282 aa, Methylobacterium sp. ME121; identical to SEQ ID NO: 638

SEQ ID NO: 885 - protein, 281 aa, Litoreibacter meonggei DSM 29466
MESQNNAGISHRKARGRPRDWDDKSAQNTIKSLDRAMEVFEFLSEAQGKTLTMLANDLSQSPATVYRILVTLEGRGLVEFDQIDQVWHVGPRAFIIGSRFLRRTTLVDRARPILRTLMEQTGETANLGIEQNGHVLFVSQVETHASIRAFFPPGTLSRLHASGIGKALLSQMEDARVDKFLTDMPLESFTEFTLTQPDALKADLELTRQRGYSIDGEERNVGMRCIAAPVFDIHGEAIAGISVSGPTSRVGTEEIANLSTSVLSAARELSAAIGGVAPAAR

SEQ ID NO: 886 - protein, 281 aa, Litoreibacter halocynthiae DSM 29467
MDSQDNAGISQRKARGRPRDWDDKSAQNTIKSLDRAMEVFEFLSEAQGKTLTMLANDLSQSPATVYRILVTLEGRGLVEFDQDDQVWHIGPRAFVIGARFLRRTSLVERARPVLRSLMEDTGETANLGIEQNGHVLFVSQVETTASIRAFFPPGTLSRMHASGIGKALLAEMEEHRISKLLSKAPLEGFTEFTLTDHTALLEDLRLSKARGYAIDGEERNLGMRCIAAPVFDINGEAIAGISVSGPTTRVGADQVAALSEAVVAAASRLTNAIGGAAVPAR

SEQ ID NO: 887 - protein, 275 aa, Roseivivax lentus DSM 29430
MQAPKRQRGRPKSQFTESSAGTLQSLDRALSVLVALSRAGRMTLSDLALAVGVPTATTHRILMTLQKHDFVAFDEDRQDWLIGIEAFRTGAAFLKRSNLVEIGRPVMQLLMEETGETANLAVPQKAEVVFVGQIETLNPIRAFFPPGTRTAMHASGTGKAILADLPEDKVKRLLSAAGLERFTANTRTTPADLFADLARTRARGWSFDREERYESMSCIGATIFDEMGNPCAGVSISGPSIRFDEDRIAAFGTAVKNAADEITRRLGGLPPERAR

SEQ ID NO: 888 - protein, 275 aa, Rhodovulum sulfidophilum DSM 2351
MTQPRPRGRPRAFHDKTDQNTVRALDRAMGLLTALSETKGLTLSELAALSNQSPATVYRVLITLQGHDIVELEEEAQRWHVGPGAFRIGSGFLRRTNVAERSRGAMQALMRATGETANLGVEDRDEVLFLTQVETHETIRAFFSPGTRGPMHCSGIGKALLAFLPAARVAAILETQGLPGFTPRSITSETGLHADLDRTRARGYAIDDQERAEGMRCIAAPIFNAHGEPIAGLSVSGPAFRIPLDAADGIGAEVRAAADRVTAATGGISPTEKSA

SEQ ID NO: 889 - protein, 285 aa, Roseobacter denitrificans DSM 7001; identical to SEQ ID NO: 604

SEQ ID NO: 890 - protein, 277 aa, Leisingera sp. ANG-Vp
MPQPPRRKGRPKSFDSASQPATIQSLDRALDVLDALAGASGMTLTELSSALDQSAATMYRVLSTLEARQIVEMEPQSQTWHIGAMAFRLGSAFLRRSSVIERARPVMRELMEATGETSNLGIERGGDVMFVSQVETHESIRAFFPPGTTSPMHASGIGKALLSCFEDDQLTRFLRGRALERFTEKTLTSAEALCADLAQIRQRGWSFDDEEKAPGMRCVAAPVFGMQGEVLAGISISGPTARMPDGGISGIGALVKDAAQKLSYGLGAPAADETPPG

SEQ ID NO: 891 - protein, 275 aa, Marivita hallyeonensis DSM 29431
MNAEAPPERRSRGRPRAWGDTTEQNKIKSLDRALMILERLGERGGATLTDLAEDLKQSPATVYRVLFTFEARGIVDFDPSAQTWHIGAGAFQIGSRFLRRTSLVERARPFLRELMQRTEETANLGMMRDGQVLFLSQVETHHNIRAFFPPGAMSDMHASGIGKALLAQLPDKDVASIIRARKLSRFTDETLVTPEALAADLEQTRRRGYAFDKEEKNPGMRCIAAPVFDMHSEPIAGVSISGPSARIPDERVEELARAVQHAATQLTEALGGTPP

SEQ ID NO: 892 - protein, 282 aa, Labrenzia alba CECT 7551
MPDPKMEATATRRARGRPRSWDDKSGQNTIKSLDRAMSVFEHLSTQRGVSLSALSDQLGESTATLYRILFTLETRGLVEFDQAEQLWHIGSGAFIIGARFLRRTSLVERARPILRKLMEDTGETANLGVSQSHQVLFVSQVETHSNIRAFFPPGTLSPMHASGIGKALLAFMDPDLCERIVSRGQMERFTEHTLCDAEGLMADLEQIRKRGYSIDGEEKNVGMRCIAAPVFDHFGEAVAGLSVSGPTSRVSQDKIDTLSVGVMAAAEALTSAIGGDVTRQRS

SEQ ID NO: 893 - protein, 275 aa, Labrenzia alba CECT 7551
MTEKQATIRRGRPKRTERDPDTAGPTILALDRGLNALIFLADNQNATLTEISRGTNTPVATAHRILTTLQQRGMVLFNENEGNWTVGAQAFRVGNAYQAGSNLMAAATPVMEELSQLTGETANLAIEDSGELLYLIQVESNNPIRASLKNGAASYFHTSGVGKALLAYKDKTQLERFLKGRSLVRQTSKSITDHDLLKSELIRIKEMGWALDDEERYMGMRCIAAPVYDPLGQAMAGVSISGPSSRFPDDQLQNLASKVQNAAGRISKSLESSDF

SEQ ID NO: 894 - protein, 269 aa, Thalassobius abyssi DSM 100673
MSSPPRQRGRPKSFHSKQAQNTIQSLDRAIDVLEHLAQHGSQTLTEISTSMEQSPATIYRVLTTFEARGLVETEGLSQVWAIGPATFRIGSSFLRRTSLVERARPAMRSLMETTGETANLGIRTGANVIFISQVETHHSIRAFFPPGTISAIHASGIGKALLSAMSEESVRELLKRSSLEAFTRNTMSDLDALCADLQISRDRGFALDDEERTEGMRCIAAPIRDLNGDTVAGVSISGPSHRMKPSVVKEFGTLVKTVGENLSSSLGAP

SEQ ID NO: 895 - protein, 277 aa, Roseovarius indicus B108 cultivar; identical to SEQ ID NO: 878

SEQ ID NO: 896 - protein, 276 aa, Litoreibacter ponti DSM 100977
MLESAPKKRARGRPKAFNDKSEQNTVQSLERALSVLKHLAEQRGIALSDLAKETDQSPATLYRILTTFQLHQMTEFDENEQLWHIGAGAYRVGANYLRRTSVVERSRPVMRQLMQDTGETANLGVEQADMVLFVSQVETHESIRAFFPPGTQSKMHASGIGKALLAYYPPERLDQWFLQQRLTRYTDATITDPDVLRQELADIRVTGLSFDNEEKNIGMRCIASPVFDGFGEPVAGLSVSGPSSRMTDAMIDAIGAHVKAAAARVTEAVGGQPPER

SEQ ID NO: 897 - protein, 280 aa, Yangia sp. CCB-MM3
MDSPKDAETSPRRARGRPRGWEDNSAQNTIKSLDRAMEVLDYLSAHPGLTLSELAGDLRQSPATVYRILVTLEGRRLVEFDPAEQLWHIGPQAFVIGARFLRRTSLVERARPILRALMEETGETANLGIVREASVLFVSQVETHESIRAFFPPGTLSPLHASGIGKALLAEMAGERLEKLLARKMERFTAHTLAEPEALRADLAAIRARGYSIDAEEKNLGMRCIAAAVFDASGEAAAGISVSGPTIRMREDMTDETSRAVMRAARELTSAIGGVTPPER

SEQ ID NO: 898 - protein, 275 aa, Granulosicoccus antarcticus IMCC3135
MKRPVIAAEPPKRGRGRPRLQHSDTEVSVVQALDRGLTLLQILAREGAVNLTDLSLQAGMPAPTAHRLLTTLMRQQFAAYNESTQMWTVGVQAYSVGSSYLARTSLVELAKPVMRTLMEETGETANLAVTEGGYVVFLSQVESNHPIRAYHRPGSRSHLHVSGIGKALLACRSKSEVEKILQKRGLPAFTPHTLSSPSALFENLELTRQRGWSFDNEEHFEGMRCVAAAITDAQGESLAGISVSGPSTRFPENHVAEIGPKVQRAAEQISRELGA

SEQ ID NO: 899 - protein, 282 aa, Tateyamaria omphalii DOK1-4
MSDLQNAQESPRRARGRPRGWDDKTEQNTIKSLDRAMEIFEYLSTDQGKTLSQLASELNQSPATVYRVLITLEARGLVEFDAEEQRWYIGARAFVIGARFLRRTSLVDRARPILRALMERTGETANLGIEKGGMVLFLNQVETHESIRAFFPPGTLSDMHASGIGKALLAFMDEDRFGRWLRGRSFETFTAHTLVAPDALVQELHRTRVRGYAIDAEEKNLGMRCIAAPVFDMYGEAVAGISVSGPATRMGSDVTDRISRSVVDAASELTRAVGGADRHAVG

SEQ ID NO: 900 - DNA, 999 bp, Artificial
  Arabidopsis codon-optimized sequence of IsRed enzyme from Paracoccus denitrificans DSM 413 targeted to plant peroxisomes
  misc_feature (4)..(30): tag for immunoblot analysis
  misc_feature (988)..(996): peroxisomal targeting sequence
atgtacccttacgatgtgcctgattacgctctcgtggttgccgagaaagaaatcgctggacttatgactcctgaggctgctttcgaagctatcgaggctgttttcgcttctatggctaggcgtaaggcttacaacttccctgttgttcgtgaggctatcggacatgaggatgcactctatggattcaaaggcgggttcgatgcttctgctcttgttcttggacttaaggccggtggatactggccgaacaaccagaagcacaacctcatcaaccaccagtctaccgtgttcctcttcgatcctgataccggaagagtgtctgctgctgttggaggaaaccttctcactgctcttagaaccgctgctgctagcgctgtgtctatcaagtatcttgctccgaagggtgctaaggtgctcggaatgattggagctggacatcagtctgctttccagatgagagctgctgcaaacgtgcacaggttcgagaaggttatcggatggaatccgcatcctgagatgctttctagactcgctgatacggctgctgagcttggacttccatttgaggctgttgagttggatagactcggagctgaggctgatgtgatcgtgtcgattaccagctctttcagccctctgctcatgaacgagcatgtgaagggacctactcatatcgctgctatgggaaccgataccaaggggaagcaagagcttgatcctgctttggtggctagggctagaatcttcactgatgaggtggcacagtccgtgtctatcggagaatgtcaacacgctattgctgctggactcatccgtgaggatcaagttggagaacttggagctgttgtggctggtgatgatcctggaagaggtgatgctgaggtgaccattttcgatggaactggtgttggactccaggatcttgctgttgctcaagctgttgtcgagctggctaagcacaagggtgttgcacaagaggtcgagatctctaagctctga

SEQ ID NO: 901 - protein, 332 aa, Artificial
  IsRed enzyme from Paracoccus denitrificans DSM 413 targeted to plant peroxisomes
  MISC_FEATURE (2)..(10): tag for immunoblot analysis
  MISC_FEATURE (330)..(332): peroxisomal targeting sequence
MYPYDVPDYALVVAEKEIAGLMTPEAAFEAIEAVFASMARRKAYNFPVVREAIGHEDALYGFKGGFDASALVLGLKAGGYWPNNQKHNLINHQSTVFLFDPDTGRVSAAVGGNLLTALRTAAASAVSIKYLAPKGAKVLGMIGAGHQSAFQMRAAANVHRFEKVIGWNPHPEMLSRLADTAAELGLPFEAVELDRLGAEADVIVSITSSFSPLLMNEHVKGPTHIAAMGTDTKGKQELDPALVARARIFTDEVAQSVSIGECQHAIAAGLIREDQVGELGAVVAGDDPGRGDAEVTIFDGTGVGLQDLAVAQAVVELAKHKGVAQEVEISKL

SEQ ID NO: 902 - DNA, 1209 bp, Artificial
  BHAA enzyme from Paracoccus denitrificans DSM 413 containing a plant peroxisome targeting sequence
  misc_feature (4)..(21): tag for immunoblot analysis
  misc_feature (22)..(49): peroxisomal targeting sequence
atgcatcaccatcaccaccaccgattagctgttctctcaggtcatttaaacgctaagaccgacttttctggatacgaggtgggatacgatatccctgctttgcctggaatggacgagtctgagatccagacaccttgccttatcctcgatcttgatgctctcgagcgtaacatccgtaagatgggagattacgctaaggctcacggaatgaggcatcgttctcatgggaagatgcacaagtctgtggatgtgcagaagctccaagagtctctcggaggatctgttggagtttgctgccagaaagtttctgaggctgaagctttcgctcgtggcggaatcaaggatgttcttgtgactaacgaggtgagagagccggctaagatcgatagacttgctagactccctaagaccggtgctactgttactgtttgcgttgacgacgtgcagaatatcgctgatctttctgctgctgctcagaagcacggaactgagcttggaatcttcgttgagatcgattgcggagctggaagatgcggagttactaccaaagaggctgttgtcgagatcgctaaggcagctgctgcagctcctaaccttactttcaagggaatccaggcttaccagggtgctatgcagcacatggattctttcgaggaccgtaaggctaagctcgatgctgctatcgctcaagtgaaagaagctgtggacgctcttgaagctgaaggacttgctcctgagttcgtttctggtggtggaaccggatcttactacttcgagagcaacagcgggatctacaacgagcttcagtgtgggtcttacgctttcatggatgctgactacggaaggatccatgacgctgagggaaagcgtattgatcagggcgaatgggagaacgcccttttcatcctcacctctgtgatgtctcatgctaagcctcatctcgctgttgtggatgctggacttaaggctcagtctgttgattctggactcccgttcgtgtacggaagggatgatgtgaagtacatcaagtgctctgacgagcacggtgtggtggaagataaggatggtgttctcaaggtgaacgacaagctcaggcttgttcctggacattgcgatcctacttgcaacgtgcacgattggtacgtgggagtgagaaacggaaaggttgagactgtttggcctgtgtctgctcgtggaaagggatactga

SEQ ID NO: 903 - protein, 402 aa, Artificial
  BHAA enzyme from Paracoccus denitrificans DSM 413 containing a plant peroxisome targeting sequence
  MISC_FEATURE (2)..(7): tag for immunoblot analysis
  MISC_FEATURE (8)..(16): peroxisomal targeting sequence
MHHHHHHRLAVLSGHLNAKTDFSGYEVGYDIPALPGMDESEIQTPCLILDLDALERNIRKMGDYAKAHGMRHRSHGKMHKSVDVQKLQESLGGSVGVCCQKVSEAEAFARGGIKDVLVTNEVREPAKIDRLARLPKTGATVTVCVDDVQNIADLSAAAQKHGTELGIFVEIDCGAGRCGVTTKEAVVEIAKAAAAAPNLTFKGIQAYQGAMQHMDSFEDRKAKLDAAIAQVKEAVDALEAEGLAPEFVSGGGTGSYYFESNSGIYNELQCGSYAFMDADYGRIHDAEGKRIDQGEWENALFILTSVMSHAKPHLAVVDAGLKAQSVDSGLPFVYGRDDVKYIKCSDEHGVVEDKDGVLKVNDKLRLVPGHCDPTCNVHDWYVGVRNGKVETVWPVSARGKGY

SEQ ID NO: 904 - DNA, 975 bp, Artificial
  Arabidopsis codon-optimized sequence of BHAD enzyme from Paracoccus denitrificans DSM 413 targeted to plant peroxisomes
  misc_feature (4)..(21): tag for immunoblot analysis
  misc_feature (964)..(972): peroxisomal targeting sequence
atgcatcatcaccatcaccactatatcccgacctatgaggacatgctggccgcgcatgagcggatcaagccgcatatccgccgcacgccgatccgcacctcggactatctgaacgagttgaccggcgcgcagctgttcttcaaatgcgagaacttccaggagccgggggccttcaaggtccgcggcgccaccaacgcggtcttcggcctcgacgatgcgcaggcggccaagggcgtcgcgacgcacagctcgggcaaccatgcctcgtgcctcagctacgccgccatgctgcgcggcattccctgcaacgtggtcatgccgcgcaccgcgccgcaggccaagaaggacacggtgcgccgctatggcggtgtcatcaccgaatgcgagccctcgaccagctcgcgcgaagagaccttcgccaaggtgcaggccgagaccggcggcgatttcgtccacccctataacgacccgcgcgtgatcgccggccagggcacctgcgccaaggaactggtcgagcaggtggacgggctcgacgcggtcgtggcccccatcggcggcggcggcatgatctcgggcacctgcctgacgctctcgacgctggcgcccgagaccagggtgatcgcggccgagcccgagcaggccgacgacgcctatcgcagcttcaaggccggctacatcatcgccgacgacgcgcccaagaccgtcgccgacgggctgctggtgccgctgaaggatctgacctggcatttcgtcaagaaccacgtcagcgagatctacaccgcctcggacgccgagatcgtggacgcgatgaagctgatctggaagcatctgcgcatcgtgatggagccctccagcgccgtgccgctggccaccatcctgaagaaccccgaagcctttgccggcaagcgcgtcggcgtcatcgtcaccggcggcaatgtcgatctcgacaagctgccgtggaactctaaactttga

SEQ ID NO: 905 - protein, 324 aa, Artificial
  BHAD enzyme from Paracoccus denitrificans DSM 413 containing a plant peroxisome targeting sequence
  MISC_FEATURE (2)..(7): tag for immunoblot analysis
  MISC_FEATURE (322)..(324): peroxisomal targeting sequence
MHHHHHHYIPTYEDMLAAHERIKPHIRRTPIRTSDYLNELTGAQLFFKCENFQEPGAFKVRGATNAVFGLDDAQAAKGVATHSSGNHASCLSYAAMLRGIPCNVVMPRTAPQAKKDTVRRYGGVITECEPSTSSREETFAKVQAETGGDFVHPYNDPRVIAGQGTCAKELVEQVDGLDAVVAPIGGGGMISGTCLTLSTLAPETRVIAAEPEQADDAYRSFKAGYIIADDAPKTVADGLLVPLKDLTWHFVKNHVSEIYTASDAEIVDAMKLIWKHLRIVMEPSSAVPLATILKNPEAFAGKRVGVIVTGGNVDLDKLPWNSKL

SEQ ID NO: 906 - DNA, 1227 bp, Artificial
  Arabidopsis codon-optimized sequence ofAsGAT enzyme from Paracoccus denitrificans DSM 413 targeted to plant peroxisomes
  misc_feature (4)..(30): tag for immunoblot analysis
  misc_feature (1216)..(1224): peroxisomal targeting sequence
atgtacccttacgatgtgcctgactacgctacctctcagaaccctattttcatccctgggcctacgaacatccctgaagagatgagaaaggctgtggacatgcctaccatcgatcacagatctccagtgttcggaaggatgcttcatcctgctcttgagggcgttaagaaggtgctcaagactactcaggctcaggtgttcttgttcccttctactggaactggtggatgggagactgcgattactaacacactcagccctggtgataaggtgctcgctgctagaaacggaatgttctctcaccgttggatcgacatgtgccagagacatggactcgatgtgaccttcgttgaaactccttggggagaaggtgtgcctgctgatagattcgaagagatcctcaccgctgataagggacacgagatcagagttgtgctcgctactcataacgagactgctaccggtgtgaagtccgatattgctgctgttagaagggctctcgatgctgctaaacacccggctttgcttttcgtggacggtgtctcttctatcggctctatggatttcaggatggacgagtggggagtcgatatcgctgttaccggaagccaaaagggattcatgcttcctccaggactcgctatcgttggattctctccaaaggctatggaagctgtcgagacagctagactccctaggaccttcttcgatatccgtgatatggctaccgggtacgctaggaatggatacccttatactcctccggtgggactcatcaacggacttaatgcttcttgcgagcgtatccttgctgagggacttgagaacgtgttcgctagacatcacaggatcgctagcggagttagagctgctgttgatgcttggggacttaagctctgcgctgttagacctgagctgtactctgattccgtgtctgctatcagagtgcctgagggtttcgatgctaacctcatcgtttctcacgccctcgagacttacgatatggctttcggaactggactcggacaggttgcaggtaaggttttcagaatcggacacctcggatctctgaccgatgctatggctctttctggaatcgctactgccgagatggttatggctgatcttggacttcctatccagctcggatctggtgttgctgctgctcaagaacactacagacagactactgctgctgcccaaaagaaggctgcttctaagctttga

SEQ ID NO: 907 - protein, 408 aa, Artificial
  AsGAT enzyme from Paracoccus denitrificans DSM 413 targeted to plant peroxisomes
  MISC_FEATURE (2)..(10): tag for immunoblot analysis
  MISC_FEATURE (406)..(408): peroxisomal targeting sequence
MYPYDVPDYATSQNPIFIPGPTNIPEEMRKAVDMPTIDHRSPVFGRMLHPALEGVKKVLKTTQAQVFLFPSTGTGGWETAITNTLSPGDKVLAARNGMFSHRWIDMCQRHGLDVTFVETPWGEGVPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVETARLPRTFFDIRDMATGYARNGYPYTPPVGLINGLNASCERILAEGLENVFARHHRIASGVRAAVDAWGLKLCAVRPELYSDSVSAIRVPEGFDANLIVSHALETYDMAFGTGLGQVAGKVFRIGHLGSLTDAMALSGIATAEMVMADLGLPIQLGSGVAAAQEHYRQTTAAAQKKAASKL

SEQ ID NO: 908 - DNA, 990 bp, Artificial
  Arabidopsis codon-optimized sequence of IsRed enzyme from Paracoccus denitrificans DSM 413 and for cytosolic expression
  misc_feature (4)..(30): tag for immunoblot analysis
atgtacccttacgatgtgcctgattacgctctcgtggttgccgagaaagaaatcgctggacttatgactcctgaggctgctttcgaagctatcgaggctgttttcgcttctatggctaggcgtaaggcttacaacttccctgttgttcgtgaggctatcggacatgaggatgcactctatggattcaaaggcgggttcgatgcttctgctcttgttcttggacttaaggccggtggatactggccgaacaaccagaagcacaacctcatcaaccaccagtctaccgtgttcctcttcgatcctgataccggaagagtgtctgctgctgttggaggaaaccttctcactgctcttagaaccgctgctgctagcgctgtgtctatcaagtatcttgctccgaagggtgctaaggtgctcggaatgattggagctggacatcagtctgctttccagatgagagctgctgcaaacgtgcacaggttcgagaaggttatcggatggaatccgcatcctgagatgctttctagactcgctgatacggctgctgagcttggacttccatttgaggctgttgagttggatagactcggagctgaggctgatgtgatcgtgtcgattaccagctctttcagccctctgctcatgaacgagcatgtgaagggacctactcatatcgctgctatgggaaccgataccaaggggaagcaagagcttgatcctgctttggtggctagggctagaatcttcactgatgaggtggcacagtccgtgtctatcggagaatgtcaacacgctattgctgctggactcatccgtgaggatcaagttggagaacttggagctgttgtggctggtgatgatcctggaagaggtgatgctgaggtgaccattttcgatggaactggtgttggactccaggatcttgctgttgctcaagctgttgtcgagctggctaagcacaagggtgttgcacaagaggtcgagatctga

SEQ ID NO: 909 - protein, 329 aa, Artificial
  IsRed enzyme from Paracoccus denitrificans DSM 413 for expression in plant cytosolic expression
  MISC_FEATURE (2)..(10): tag for immunoblot analysis
MYPYDVPDYALVVAEKEIAGLMTPEAAFEAIEAVFASMARRKAYNFPVVREAIGHEDALYGFKGGFDASALVLGLKAGGYWPNNQKHNLINHQSTVFLFDPDTGRVSAAVGGNLLTALRTAAASAVSIKYLAPKGAKVLGMIGAGHQSAFQMRAAANVHRFEKVIGWNPHPEMLSRLADTAAELGLPFEAVELDRLGAEADVIVSITSSFSPLLMNEHVKGPTHIAAMGTDTKGKQELDPALVARARIFTDEVAQSVSIGECQHAIAAGLIREDQVGELGAVVAGDDPGRGDAEVTIFDGTGVGLQDLAVAQAVVELAKHKGVAQEVEI

SEQ ID NO: 910 - DNA, 1182 bp, Artificial
  Arabidopsis codon-optimized sequence of BHAA enzyme from Paracoccus denitrificans DSM 413 for expression in plant cytosol
  misc_feature (4)..(31): tag for immunoblot analysis
atgcatcaccatcaccaccacaacgctaagaccgacttttctggatacgaggtgggatacgatatccctgctttgcctggaatggacgagtctgagatccagacaccttgccttatcctcgatcttgatgctctcgagcgtaacatccgtaagatgggagattacgctaaggctcacggaatgaggcatcgttctcatgggaagatgcacaagtctgtggatgtgcagaagctccaagagtctctcggaggatctgttggagtttgctgccagaaagtttctgaggctgaagctttcgctcgtggcggaatcaaggatgttcttgtgactaacgaggtgagagagccggctaagatcgatagacttgctagactccctaagaccggtgctactgttactgtttgcgttgacgacgtgcagaatatcgctgatctttctgctgctgctcagaagcacggaactgagcttggaatcttcgttgagatcgattgcggagctggaagatgcggagttactaccaaagaggctgttgtcgagatcgctaaggcagctgctgcagctcctaaccttactttcaagggaatccaggcttaccagggtgctatgcagcacatggattctttcgaggaccgtaaggctaagctcgatgctgctatcgctcaagtgaaagaagctgtggacgctcttgaagctgaaggacttgctcctgagttcgtttctggtggtggaaccggatcttactacttcgagagcaacagcgggatctacaacgagcttcagtgtgggtcttacgctttcatggatgctgactacggaaggatccatgacgctgagggaaagcgtattgatcagggcgaatgggagaacgcccttttcatcctcacctctgtgatgtctcatgctaagcctcatctcgctgttgtggatgctggacttaaggctcagtctgttgattctggactcccgttcgtgtacggaagggatgatgtgaagtacatcaagtgctctgacgagcacggtgtggtggaagataaggatggtgttctcaaggtgaacgacaagctcaggcttgttcctggacattgcgatcctacttgcaacgtgcacgattggtacgtgggagtgagaaacggaaaggttgagactgtttggcctgtgtctgctcgtggaaagggatactga

SEQ ID NO: 911 - protein, 393 aa, Artificial
  BHAA enzyme from Paracoccus denitrificans DSM 413 for expression in plant cytosol
  MISC_FEATURE (2)..(7): tag for immunoblot analysis
MHHHHHHNAKTDFSGYEVGYDIPALPGMDESEIQTPCLILDLDALERNIRKMGDYAKAHGMRHRSHGKMHKSVDVQKLQESLGGSVGVCCQKVSEAEAFARGGIKDVLVTNEVREPAKIDRLARLPKTGATVTVCVDDVQNIADLSAAAQKHGTELGIFVEIDCGAGRCGVTTKEAVVEIAKAAAAAPNLTFKGIQAYQGAMQHMDSFEDRKAKLDAAIAQVKEAVDALEAEGLAPEFVSGGGTGSYYFESNSGIYNELQCGSYAFMDADYGRIHDAEGKRIDQGEWENALFILTSVMSHAKPHLAVVDAGLKAQSVDSGLPFVYGRDDVKYIKCSDEHGVVEDKDGVLKVNDKLRLVPGHCDPTCNVHDWYVGVRNGKVETVWPVSARGKGY

SEQ ID NO: 912 - DNA, 966 bp, Artificial
  Arabidopsis codon-optimized sequence of BHAD enzyme from Paracoccus denitrificans DSM 413 for expression in plant cytosol
  misc_feature (4)..(21): tag for immunoblot analysis
atgcatcatcaccatcaccactatatcccgacctatgaggacatgctggccgcgcatgagcggatcaagccgcatatccgccgcacgccgatccgcacctcggactatctgaacgagttgaccggcgcgcagctgttcttcaaatgcgagaacttccaggagccgggggccttcaaggtccgcggcgccaccaacgcggtcttcggcctcgacgatgcgcaggcggccaagggcgtcgcgacgcacagctcgggcaaccatgcctcgtgcctcagctacgccgccatgctgcgcggcattccctgcaacgtggtcatgccgcgcaccgcgccgcaggccaagaaggacacggtgcgccgctatggcggtgtcatcaccgaatgcgagccctcgaccagctcgcgcgaagagaccttcgccaaggtgcaggccgagaccggcggcgatttcgtccacccctataacgacccgcgcgtgatcgccggccagggcacctgcgccaaggaactggtcgagcaggtggacgggctcgacgcggtcgtggcccccatcggcggcggcggcatgatctcgggcacctgcctgacgctctcgacgctggcgcccgagaccagggtgatcgcggccgagcccgagcaggccgacgacgcctatcgcagcttcaaggccggctacatcatcgccgacgacgcgcccaagaccgtcgccgacgggctgctggtgccgctgaaggatctgacctggcatttcgtcaagaaccacgtcagcgagatctacaccgcctcggacgccgagatcgtggacgcgatgaagctgatctggaagcatctgcgcatcgtgatggagccctccagcgccgtgccgctggccaccatcctgaagaaccccgaagcctttgccggcaagcgcgtcggcgtcatcgtcaccggcggcaatgtcgatctcgacaagctgccgtggaactga

SEQ ID NO: 913 - protein, 321 aa, Artificial
  BHAD enzyme from Paracoccus denitrificans DSM 413 for expression in plant cytosol
  MISC_FEATURE (2)..(7): tag for immunoblot analysis
MHHHHHHYIPTYEDMLAAHERIKPHIRRTPIRTSDYLNELTGAQLFFKCENFQEPGAFKVRGATNAVFGLDDAQAAKGVATHSSGNHASCLSYAAMLRGIPCNVVMPRTAPQAKKDTVRRYGGVITECEPSTSSREETFAKVQAETGGDFVHPYNDPRVIAGQGTCAKELVEQVDGLDAVVAPIGGGGMISGTCLTLSTLAPETRVIAAEPEQADDAYRSFKAGYIIADDAPKTVADGLLVPLKDLTWHFVKNHVSEIYTASDAEIVDAMKLIWKHLRIVMEPSSAVPLATILKNPEAFAGKRVGVIVTGGNVDLDKLPWN

SEQ ID NO: 914 - DNA, 1218 bp, Artificial
  Arabidopsis codon-optimized sequence of AsGAT enzyme from Paracoccus denitrificans DSM 413 for expression in plant cytosol
  misc_feature (4)..(30): tag for immunoblot analysis
atgtacccttacgatgtgcctgactacgctacctctcagaaccctattttcatccctgggcctacgaacatccctgaagagatgagaaaggctgtggacatgcctaccatcgatcacagatctccagtgttcggaaggatgcttcatcctgctcttgagggcgttaagaaggtgctcaagactactcaggctcaggtgttcttgttcccttctactggaactggtggatgggagactgcgattactaacacactcagccctggtgataaggtgctcgctgctagaaacggaatgttctctcaccgttggatcgacatgtgccagagacatggactcgatgtgaccttcgttgaaactccttggggagaaggtgtgcctgctgatagattcgaagagatcctcaccgctgataagggacacgagatcagagttgtgctcgctactcataacgagactgctaccggtgtgaagtccgatattgctgctgttagaagggctctcgatgctgctaaacacccggctttgcttttcgtggacggtgtctcttctatcggctctatggatttcaggatggacgagtggggagtcgatatcgctgttaccggaagccaaaagggattcatgcttcctccaggactcgctatcgttggattctctccaaaggctatggaagctgtcgagacagctagactccctaggaccttcttcgatatccgtgatatggctaccgggtacgctaggaatggatacccttatactcctccggtgggactcatcaacggacttaatgcttcttgcgagcgtatccttgctgagggacttgagaacgtgttcgctagacatcacaggatcgctagcggagttagagctgctgttgatgcttggggacttaagctctgcgctgttagacctgagctgtactctgattccgtgtctgctatcagagtgcctgagggtttcgatgctaacctcatcgtttctcacgccctcgagacttacgatatggctttcggaactggactcggacaggttgcaggtaaggttttcagaatcggacacctcggatctctgaccgatgctatggctctttctggaatcgctactgccgagatggttatggctgatcttggacttcctatccagctcggatctggtgttgctgctgctcaagaacactacagacagactactgctgctgcccaaaagaaggctgcttga

SEQ ID NO: 915 - protein, 405 aa, Artificial
  AsGAT enzyme from Paracoccus denitrificans DSM 413 for expression in plant cytosol
  MISC_FEATURE (2)..(10): tag for immunoblot analysis
MYPYDVPDYATSQNPIFIPGPTNIPEEMRKAVDMPTIDHRSPVFGRMLHPALEGVKKVLKTTQAQVFLFPSTGTGGWETAITNTLSPGDKVLAARNGMFSHRWIDMCQRHGLDVTFVETPWGEGVPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVETARLPRTFFDIRDMATGYARNGYPYTPPVGLINGLNASCERILAEGLENVFARHHRIASGVRAAVDAWGLKLCAVRPELYSDSVSAIRVPEGFDANLIVSHALETYDMAFGTGLGQVAGKVFRIGHLGSLTDAMALSGIATAEMVMADLGLPIQLGSGVAAAQEHYRQTTAAAQKKAA

SEQ ID NO: 916 - DNA, 156 bp, Artificial
  Arabidopsis Ferredoxin-2 chloroplastic target peptide for N-terminal fusion to target BHAP proteins to plant chloroplasts.
atggcttccactgctctctcaagcgccatcgtcggaacttcattcatccgtcgttccccagctccaatcagtctccgttcccttccatcagccaacacacaatccctcttcggtctcaaatcaggcaccgctcgtggtggacgtgtcacagccatg

SEQ ID NO: 917 - protein, 52 aa, Artificial
  Arabidopsis Ferredoxin-2 chloroplastic target peptide for N-terminal fusion to target BHAP proteins to plant chloroplasts.
MASTALSSAIVGTSFIRRSPAPISLRSLPSANTQSLFGLKSGTARGGRVTAM

SEQ ID NO: 918 - DNA, 90 bp, Artificial
  Arabidopsis serine hydroxymethyl transferase target peptide for N-terminal fusion to target BHAP proteins to plant mitochondria.
atggcgatggccatggctcttcgaaggctttcttcttcaattgacaaacccattcgtcctcttattcgatccacttcatgttacatgtct

SEQ ID NO: 919 - protein, 30 aa, Artificial
  Arabidopsis serine hydroxymethyl transferase target peptide for N-terminal fusion to target BHAP proteins to plant mitochondria.
MAMAMALRRLSSSIDKPIRPLIRSTSCYMS

SEQ ID NO: 920 - DNA, 725 bp, Artificial
  Nucleic acid sequence coding Dicosoma sp. red fluorescent protein (mCherry)
atggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaaaaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagaacgcggctattagatc

SEQ ID NO: 921 - protein, 241 aa, Artificial
  Dicosoma sp. red fluorescent protein (mCherry)
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKNAAIR

SEQ ID NO: 922 - DNA, 733 bp, Artificial
  Nucleic acid sequence coding enhanced green fluorescent protein
atggtgagcaagggcgaggagctgttcaccggggtggtgcccatcctggtcagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagggttctggtagcggagg

SEQ ID NO: 923 - protein, 244 aa, Artificial
  enhanced green fluorescent protein.
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGSGSG

SEQ ID NO: 924 - DNA, 276 bp, Artificial
  Agrobacterium tumefaciens NOS promoter
agcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctca

SEQ ID NO: 925 - DNA, 387 bp, Artificial
  Agrobacterium tumefaciens MAS promoter
ggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcg

SEQ ID NO: 926 - DNA, 1342 bp, Artificial
  cauliflower mosaic virus 35S promoter
ggaggaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaagtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtcaagactggcgaacagttcatacagagtcttttacgactcaatgacaagaagaaaatcttcgtcaacatggtggagcacgacactctggtctactccaaaaatgtcaaagatacagtctcagaagatcaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagaggttccaaccacgtctacaaagcaagtggattgatgtgacatctccactgacgtaagggatgacgcacaatcccactatccttcgcaagacccttcctctatataaggaagttcatttcatttggagaggacacgc

SEQ ID NO: 927 - DNA, 33 bp, Artificial
  primer for cloning of IsRed in pICH41308, fwd
ttgaagacaaaatgtacccttacgatgtgcctg

SEQ ID NO: 928 - DNA, 39 bp, Artificial
  primer for cloning of IsRed in pICH41308, rev
ttgaagacaaaagctcagagcttagasgatctcgacctc

SEQ ID NO: 929 - DNA, 79 bp, Artificial
  primer for cloning of BHAA in pICH41308, fwd
ttgaagacaaaatgcatcaccatcaccaccaccgattagctgttctctcaggtcatttaaacgctaagaccgacttttc

SEQ ID NO: 930 - DNA, 35 bp, Artificial
  primer for cloning of BHAA in pICH41308, rev
ttgaagacaaaagctcagtatccctttccacgagc

SEQ ID NO: 931 - DNA, 79 bp, Artificial; identical to SEQ ID NO: 929
  primer for cloning of BHAA in pAGM1299 without stop codon, fwd

SEQ ID NO: 932 - DNA, 34 bp, Artificial
  primer for cloning of BHAA in pAGM1299 without stop codon, rev
ttgaagacaacgaaccgtatccctttccacgagc

SEQ ID NO: 933 - DNA, 29 bp, Artificial
  primer for cloning of BHAD in pICH41308, fwd
ttgaagacaaaatgcatcaccatcaccac

SEQ ID NO: 934 - DNA, 33 bp, Artificial
  primer for cloning of BHAD in pICH41308, rev
ttgaagacaaaagctcaaagcttgctgttccac

SEQ ID NO: 935 - DNA, 30 bp, Artificial
  primer for cloning of ASGAT in pICH41308, fwd
ttgaagacaaaatgtacccttacgatgtgc

SEQ ID NO: 936 - DNA, 33 bp, Artificial
  primer for cloning of ASGAT in pICH41308, rev
ttgaagacaaaagctcaaagcttagaagcagcc

SEQ ID NO: 937 - DNA, 20 bp, Artificial
  Primer used to assess the integration of AsGAT under control of chlorophyll A binding protein promoter, fwd
gactagccaatagcaacctc

SEQ ID NO: 938 - DNA, 21 bp, Artificial
  Primer used to assess the integration of AsGAT under control of chlorophyll A binding protein promoter, rev
ctctgatagcagacacggaat

SEQ ID NO: 939 - DNA, 21 bp, Artificial
  Primer used to assess the integration of BHAA under control of RubisCO small subunit 2B promoter, fwd
ccagtagccatacacattcac

SEQ ID NO: 940 - DNA, 19 bp, Artificial
  Primer used to assess the integration of BHAA under control of RubisCO small subunit 2B promoter, rev
gcttgtcgttcaccttgag

SEQ ID NO: 941 - DNA, 18 bp, Artificial
  Primer used to assess the integration of BHAD under control of RubisCO small subunit 1B promoter, fwd
gagccaaagcaaccgatc

SEQ ID NO: 942 - DNA, 20 bp, Artificial
  Primer used to assess the integration of BHAD under control of RubisCO small subunit 1B promoter, rev
gatctgtaagcgtcatcagc

SEQ ID NO: 943 - DNA, 19 bp, Artificial
  Primer used to assess the integration of ISRed under control of RubisCO small subunit 3B promoter, fwd
gaaaggagccaaaagcaac

SEQ ID NO: 944 - DNA, 19 bp, Artificial
  Primer used to assess the integration of ISRed under control of RubisCO small subunit 3B promoter, rev
gtccaacaccagttccatc

SEQ ID NO: 945 - DNA, 20 bp, Artificial
  primer for Actin 2 amplification, fwd
gttgggatgaaccagaagga

SEQ ID NO: 946 - DNA, 20 bp, Artificial
  primer for Actin 2 amplification, rev
gaaccaccgatccagacact

SEQ ID NO: 947 - DNA, 22 bp, Artificial
  primer for wildtype GGT1 amplification, fwd
ccttgcccttggctctagaacc

SEQ ID NO: 948 - DNA, 24 bp, Artificial
  primer for wildtype GGT1 amplification, rev
gtcatacctaaaccgcctgaagtc

SEQ ID NO: 949 - DNA, 21 bp, Artificial
  primer for verification of T-DNA integration in the GGT1 locus, fwd
taactctccccactctttgcc

SEQ ID NO: 950 - DNA, 23 bp, Artificial
  primer for verification of T-DNA integration in the GGT1 locus, rev
atattgaccatcatactcattgc

SEQ ID NO: 951 - DNA, 27 bp, Artificial Sequence
  nucleic acid sequence coding the peroxisomal targeting signal 2 (PTS2) from Arabidopsis peroxisomal citrate synthase 3 (At2g42790)
cgattagctgttctctcaggtcattta

SEQ ID NO: 952 - protein, 9 aa, Artificial Sequence
  peroxisomal targeting signal 2 (PTS2) from Arabidopsis peroxisomal citrate synthase 3 (At2g42790) for N-terminal fusion
RLAVLSGHL

SEQ ID NO: 953 - protein, 387 aa, Paracoccus denitrificans
  PEPTIDE (1)..(387): Pden_3919 BHAA
MNAKTDFSGYEVGYDIPALPGMDESEIQTPCLILDLDALERNIRKMGDYAKAHGMRHRSHGKMHKSVDVQKLQESLGGSVGVCCQKVSEAEAFARGGIKDVLVTNEVREPAKIDRLARLPKTGATVTVCVDDVQNIADLSAAAQKHGTELGIFVEIDCGAGRCGVTTKEAVVEIAKAAAAAPNLTFKGIQAYQGAMQHMDSFEDRKAKLDAAIAQVKEAVDALEAEGLAPEFVSGGGTGSYYFESNSGIYNELQCGSYAFMDADYGRIHDAEGKRIDQGEWENALFILTSVMSHAKPHLAVVDAGLKAQSVDSGLPFVYGRDDVKYIKCSDEHGVVEDKDGVLKVNDKLRLVPGHCDPTCNVHDWYVGVRNGKVETVWPVSARGKGY

SEQ ID NO: 954 - protein, 315 aa, Paracoccus denitrificans
  PEPTIDE (1)..(315): Pden_3920 BHAD
MYIPTYEDMLAAHERIKPHIRRTPIRTSDYLNELTGAQLFFKCENFQEPGAFKVRGATNAVFGLDDAQAAKGVATHSSGNHASCLSYAAMLRGIPCNVVMPRTAPQAKKDTVRRYGGVITECEPSTSSREETFAKVQAETGGDFVHPYNDPRVIAGQGTCAKELVEQVDGLDAVVAPIGGGGMISGTCLTLSTLAPETRVIAAEPEQADDAYRSFKAGYIIADDAPKTVADGLLVPLKDLTWHFVKNHVSEIYTASDAEIVDAMKLIWKHLRIVMEPSSAVPLATILKNPEAFAGKRVGVIVTGGNVDLDKLPWN

SEQ ID NO: 955 - protein, 396 aa, Artificial Sequence
  BHAA enzyme derived from Paracoccus denitrificans DSM 413 containing a plant peroxisome targeting sequence and without tag for immunoblot analysis
  MISC_FEATURE (2)..(10): peroxisomal targeting sequence
MRLAVLSGHLNAKTDFSGYEVGYDIPALPGMDESEIQTPCLILDLDALERNIRKMGDYAKAHGMRHRSHGKMHKSVDVQKLQESLGGSVGVCCQKVSEAEAFARGGIKDVLVTNEVREPAKIDRLARLPKTGATVTVCVDDVQNIADLSAAAQKHGTELGIFVEIDCGAGRCGVTTKEAVVEIAKAAAAAPNLTFKGIQAYQGAMQHMDSFEDRKAKLDAAIAQVKEAVDALEAEGLAPEFVSGGGTGSYYFESNSGIYNELQCGSYAFMDADYGRIHDAEGKRIDQGEWENALFILTSVMSHAKPHLAVVDAGLKAQSVDSGLPFVYGRDDVKYIKCSDEHGVVEDKDGVLKVNDKLRLVPGHCDPTCNVHDWYVGVRNGKVETVWPVSARGKGY

SEQ ID NO: 956 - protein, 318 aa, Artificial Sequence
  BHAD enzyme from Paracoccus denitrificans DSM 413 containing a plant peroxisome targeting sequence and without tags for immunoblot
  MISC_FEATURE (316)..(318): peroxisomal targeting sequence
MYIPTYEDMLAAHERIKPHIRRTPIRTSDYLNELTGAQLFFKCENFQEPGAFKVRGATNAVFGLDDAQAAKGVATHSSGNHASCLSYAAMLRGIPCNVVMPRTAPQAKKDTVRRYGGVITECEPSTSSREETFAKVQAETGGDFVHPYNDPRVIAGQGTCAKELVEQVDGLDAVVAPIGGGGMISGTCLTLSTLAPETRVIAAEPEQADDAYRSFKAGYIIADDAPKTVADGLLVPLKDLTWHFVKNHVSEIYTASDAEIVDAMKLIWKHLRIVMEPSSAVPLATILKNPEAFAGKRVGVIVTGGNVDLDKLPWNSKL

SEQ ID NO: 957 - protein, 322 aa, Artificial Sequence
  ISRed enzyme derived from Paracoccus denitrificans DSM 413 containing a plant peroxisome targeting sequence and without tags for immunoblot
  MISC_FEATURE (320)..(322): peroxisomal targeting sequence
MLVVAEKEIAGLMTPEAAFEAIEAVFASMARRKAYNFPVVREAIGHEDALYGFKGGFDASALVLGLKAGGYWPNNQKHNLINHQSTVFLFDPDTGRVSAAVGGNLLTALRTAAASAVSIKYLAPKGAKVLGMIGAGHQSAFQMRAAANVHRFEKVIGWNPHPEMLSRLADTAAELGLPFEAVELDRLGAEADVIVSITSSFSPLLMNEHVKGPTHIAAMGTDTKGKQELDPALVARARIFTDEVAQSVSIGECQHAIAAGLIREDQVGELGAVVAGDDPGRGDAEVTIFDGTGVGLQDLAVAQAVVELAKHKGVAQEVEISK

SEQ ID NO: 958 - protein, 399 aa, Artificial Sequence
  AsGAT enzyme derived from Paracoccus denitrificans DSM 413 containing a plant peroxisome targeting sequence and without tags for immunoblot analysis
  MISC_FEATURE (397)..(399): peroxisomal targeting sequence
MTSQNPIFIPGPTNIPEEMRKAVDMPTIDHRSPVFGRMLHPALEGVKKVLKTTQAQVFLFPSTGTGGWETAITNTLSPGDKVLAARNGMFSHRWIDMCQRHGLDVTFVETPWGEGVPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVETARLPRTFFDIRDMATGYARNGYPYTPPVGLINGLNASCERILAEGLENVFARHHRIASGVRAAVDAWGLKLCAVRPELYSDSVSAIRVPEGFDANLIVSHALETYDMAFGTGLGQVAGKVFRIGHLGSLTDAMALSGIATAEMVMADLGLPIQLGSGVAAAQEHYRQTTAAAQKKAASKL

SEQ ID NO: 959 - DNA, 1191 bp, Artificial Sequence
  Arabidopsis codon-optimized sequence of BHAA enzyme from Paracoccus denitrificans DSM 413 containing a plant peroxisome targeting sequence and without tags for immunoblot analysis
  misc_feature (4)..(30): peroxisomal targeting sequence
atgcgattagctgttctctcaggtcatttaaacgctaagaccgacttttctggatacgaggtgggatacgatatccctgctttgcctggaatggacgagtctgagatccagacaccttgccttatcctcgatcttgatgctctcgagcgtaacatccgtaagatgggagattacgctaaggctcacggaatgaggcatcgttctcatgggaagatgcacaagtctgtggatgtgcagaagctccaagagtctctcggaggatctgttggagtttgctgccagaaagtttctgaggctgaagctttcgctcgtggcggaatcaaggatgttcttgtgactaacgaggtgagagagccggctaagatcgatagacttgctagactccctaagaccggtgctactgttactgtttgcgttgacgacgtgcagaatatcgctgatctttctgctgctgctcagaagcacggaactgagcttggaatcttcgttgagatcgattgcggagctggaagatgcggagttactaccaaagaggctgttgtcgagatcgctaaggcagctgctgcagctcctaaccttactttcaagggaatccaggcttaccagggtgctatgcagcacatggattctttcgaggaccgtaaggctaagctcgatgctgctatcgctcaagtgaaagaagctgtggacgctcttgaagctgaaggacttgctcctgagttcgtttctggtggtggaaccggatcttactacttcgagagcaacagcgggatctacaacgagcttcagtgtgggtcttacgctttcatggatgctgactacggaaggatccatgacgctgagggaaagcgtattgatcagggcgaatgggagaacgcccttttcatcctcacctctgtgatgtctcatgctaagcctcatctcgctgttgtggatgctggacttaaggctcagtctgttgattctggactcccgttcgtgtacggaagggatgatgtgaagtacatcaagtgctctgacgagcacggtgtggtggaagataaggatggtgttctcaaggtgaacgacaagctcaggcttgttcctggacattgcgatcctacttgcaacgtgcacgattggtacgtgggagtgagaaacggaaaggttgagactgtttggcctgtgtctgctcgtggaaagggatactga

SEQ ID NO: 960 - DNA, 957 bp, Artificial Sequence
  Arabidopsis codon-optimized sequence of BHAD enzyme from Paracoccus denitrificans DSM 413 containing a plant peroxisome targeting sequence and without tags for imunoblot analysis
  misc_feature (946)..(954): peroxisomal targeting sequence
atgtatatcccgacctatgaggacatgctggccgcgcatgagcggatcaagccgcatatccgccgcacgccgatccgcacctcggactatctgaacgagttgaccggcgcgcagctgttcttcaaatgcgagaacttccaggagccgggggccttcaaggtccgcggcgccaccaacgcggtcttcggcctcgacgatgcgcaggcggccaagggcgtcgcgacgcacagctcgggcaaccatgcctcgtgcctcagctacgccgccatgctgcgcggcattccctgcaacgtggtcatgccgcgcaccgcgccgcaggccaagaaggacacggtgcgccgctatggcggtgtcatcaccgaatgcgagccctcgaccagctcgcgcgaagagaccttcgccaaggtgcaggccgagaccggcggcgatttcgtccacccctataacgacccgcgcgtgatcgccggccagggcacctgcgccaaggaactggtcgagcaggtggacgggctcgacgcggtcgtggcccccatcggcggcggcggcatgatctcgggcacctgcctgacgctctcgacgctggcgcccgagaccagggtgatcgcggccgagcccgagcaggccgacgacgcctatcgcagcttcaaggccggctacatcatcgccgacgacgcgcccaagaccgtcgccgacgggctgctggtgccgctgaaggatctgacctggcatttcgtcaagaaccacgtcagcgagatctacaccgcctcggacgccgagatcgtggacgcgatgaagctgatctggaagcatctgcgcatcgtgatggagccctccagcgccgtgccgctggccaccatcctgaagaaccccgaagcctttgccggcaagcgcgtcggcgtcatcgtcaccggcggcaatgtcgatctcgacaagctgccgtggaactctaaactttga

SEQ ID NO: 961 - DNA, 972 bp, Artificial Sequence
  Arabidopsis codon-optimized sequence of ISRed enzyme from Paracoccus denitrificans DSM 413 containing a plant peroxisome targeting sequence  and without tags for immunoblot analysis
  misc_feature (961)..(969): peroxisomal targeting sequence
atgctcgtggttgccgagaaagaaatcgctggacttatgactcctgaggctgctttcgaagctatcgaggctgttttcgcttctatggctaggcgtaaggcttacaacttccctgttgttcgtgaggctatcggacatgaggatgcactctatggattcaaaggcgggttcgatgcttctgctcttgttcttggacttaaggccggtggatactggccgaacaaccagaagcacaacctcatcaaccaccagtctaccgtgttcctcttcgatcctgataccggaagagtgtctgctgctgttggaggaaaccttctcactgctcttagaaccgctgctgctagcgctgtgtctatcaagtatcttgctccgaagggtgctaaggtgctcggaatgattggagctggacatcagtctgctttccagatgagagctgctgcaaacgtgcacaggttcgagaaggttatcggatggaatccgcatcctgagatgctttctagactcgctgatacggctgctgagcttggacttccatttgaggctgttgagttggatagactcggagctgaggctgatgtgatcgtgtcgattaccagctctttcagccctctgctcatgaacgagcatgtgaagggacctactcatatcgctgctatgggaaccgataccaaggggaagcaagagcttgatcctgctttggtggctagggctagaatcttcactgatgaggtggcacagtccgtgtctatcggagaatgtcaacacgctattgctgctggactcatccgtgaggatcaagttggagaacttggagctgttgtggctggtgatgatcctggaagaggtgatgctgaggtgaccattttcgatggaactggtgttggactccaggatcttgctgttgctcaagctgttgtcgagctggctaagcacaagggtgttgcacaagaggtcgagatctctaagctctga

SEQ ID NO: 962 - DNA, 1200 bp, Artificial Sequence
  Arabidopsis codon-optimized sequence of AsGAT enzyme from Paracoccus denitrificans DSM 413 containing a plant peroxisome targeting sequence and without tags for immunoblot analysis
  misc_feature (1189)..(1197): peroxisomal targeting sequence
atgacctctcagaaccctattttcatccctgggcctacgaacatccctgaagagatgagaaaggctgtggacatgcctaccatcgatcacagatctccagtgttcggaaggatgcttcatcctgctcttgagggcgttaagaaggtgctcaagactactcaggctcaggtgttcttgttcccttctactggaactggtggatgggagactgcgattactaacacactcagccctggtgataaggtgctcgctgctagaaacggaatgttctctcaccgttggatcgacatgtgccagagacatggactcgatgtgaccttcgttgaaactccttggggagaaggtgtgcctgctgatagattcgaagagatcctcaccgctgataagggacacgagatcagagttgtgctcgctactcataacgagactgctaccggtgtgaagtccgatattgctgctgttagaagggctctcgatgctgctaaacacccggctttgcttttcgtggacggtgtctcttctatcggctctatggatttcaggatggacgagtggggagtcgatatcgctgttaccggaagccaaaagggattcatgcttcctccaggactcgctatcgttggattctctccaaaggctatggaagctgtcgagacagctagactccctaggaccttcttcgatatccgtgatatggctaccgggtacgctaggaatggatacccttatactcctccggtgggactcatcaacggacttaatgcttcttgcgagcgtatccttgctgagggacttgagaacgtgttcgctagacatcacaggatcgctagcggagttagagctgctgttgatgcttggggacttaagctctgcgctgttagacctgagctgtactctgattccgtgtctgctatcagagtgcctgagggtttcgatgctaacctcatcgtttctcacgccctcgagacttacgatatggctttcggaactggactcggacaggttgcaggtaaggttttcagaatcggacacctcggatctctgaccgatgctatggctctttctggaatcgctactgccgagatggttatggctgatcttggacttcctatccagctcggatctggtgttgctgctgctcaagaacactacagacagactactgctgctgcccaaaagaaggctgcttctaagctttga

SEQ ID NO: 963 - DNA, 1164 bp, Artificial Sequence
  Arabidopsis codon-optimized sequence of BHAA enzyme from Paracoccus denitrificans DSM 413 for expression in plant cytosol
atgaacgctaagaccgacttttctggatacgaggtgggatacgatatccctgctttgcctggaatggacgagtctgagatccagacaccttgccttatcctcgatcttgatgctctcgagcgtaacatccgtaagatgggagattacgctaaggctcacggaatgaggcatcgttctcatgggaagatgcacaagtctgtggatgtgcagaagctccaagagtctctcggaggatctgttggagtttgctgccagaaagtttctgaggctgaagctttcgctcgtggcggaatcaaggatgttcttgtgactaacgaggtgagagagccggctaagatcgatagacttgctagactccctaagaccggtgctactgttactgtttgcgttgacgacgtgcagaatatcgctgatctttctgctgctgctcagaagcacggaactgagcttggaatcttcgttgagatcgattgcggagctggaagatgcggagttactaccaaagaggctgttgtcgagatcgctaaggcagctgctgcagctcctaaccttactttcaagggaatccaggcttaccagggtgctatgcagcacatggattctttcgaggaccgtaaggctaagctcgatgctgctatcgctcaagtgaaagaagctgtggacgctcttgaagctgaaggacttgctcctgagttcgtttctggtggtggaaccggatcttactacttcgagagcaacagcgggatctacaacgagcttcagtgtgggtcttacgctttcatggatgctgactacggaaggatccatgacgctgagggaaagcgtattgatcagggcgaatgggagaacgcccttttcatcctcacctctgtgatgtctcatgctaagcctcatctcgctgttgtggatgctggacttaaggctcagtctgttgattctggactcccgttcgtgtacggaagggatgatgtgaagtacatcaagtgctctgacgagcacggtgtggtggaagataaggatggtgttctcaaggtgaacgacaagctcaggcttgttcctggacattgcgatcctacttgcaacgtgcacgattggtacgtgggagtgagaaacggaaaggttgagactgtttggcctgtgtctgctcgtggaaagggatactga

SEQ ID NO: 964 - DNA, 948 bp, Artificial Sequence
  Arabidopsis codon-optimized sequence of BHAD enzyme from Paracoccus denitrificans DSM 413 for expression in plant cytosol
atgtatatcccgacctatgaggacatgctggccgcgcatgagcggatcaagccgcatatccgccgcacgccgatccgcacctcggactatctgaacgagttgaccggcgcgcagctgttcttcaaatgcgagaacttccaggagccgggggccttcaaggtccgcggcgccaccaacgcggtcttcggcctcgacgatgcgcaggcggccaagggcgtcgcgacgcacagctcgggcaaccatgcctcgtgcctcagctacgccgccatgctgcgcggcattccctgcaacgtggtcatgccgcgcaccgcgccgcaggccaagaaggacacggtgcgccgctatggcggtgtcatcaccgaatgcgagccctcgaccagctcgcgcgaagagaccttcgccaaggtgcaggccgagaccggcggcgatttcgtccacccctataacgacccgcgcgtgatcgccggccagggcacctgcgccaaggaactggtcgagcaggtggacgggctcgacgcggtcgtggcccccatcggcggcggcggcatgatctcgggcacctgcctgacgctctcgacgctggcgcccgagaccagggtgatcgcggccgagcccgagcaggccgacgacgcctatcgcagcttcaaggccggctacatcatcgccgacgacgcgcccaagaccgtcgccgacgggctgctggtgccgctgaaggatctgacctggcatttcgtcaagaaccacgtcagcgagatctacaccgcctcggacgccgagatcgtggacgcgatgaagctgatctggaagcatctgcgcatcgtgatggagccctccagcgccgtgccgctggccaccatcctgaagaaccccgaagcctttgccggcaagcgcgtcggcgtcatcgtcaccggcggcaatgtcgatctcgacaagctgccgtggaactga

SEQ ID NO: 965 - DNA, 963 bp, Artificial Sequence
  Arabidopsis codon-optimized sequence of IsRed enzyme from Paracoccus denitrificans DSM 413 for expression in plant cytosol
atgctcgtggttgccgagaaagaaatcgctggacttatgactcctgaggctgctttcgaagctatcgaggctgttttcgcttctatggctaggcgtaaggcttacaacttccctgttgttcgtgaggctatcggacatgaggatgcactctatggattcaaaggcgggttcgatgcttctgctcttgttcttggacttaaggccggtggatactggccgaacaaccagaagcacaacctcatcaaccaccagtctaccgtgttcctcttcgatcctgataccggaagagtgtctgctgctgttggaggaaaccttctcactgctcttagaaccgctgctgctagcgctgtgtctatcaagtatcttgctccgaagggtgctaaggtgctcggaatgattggagctggacatcagtctgctttccagatgagagctgctgcaaacgtgcacaggttcgagaaggttatcggatggaatccgcatcctgagatgctttctagactcgctgatacggctgctgagcttggacttccatttgaggctgttgagttggatagactcggagctgaggctgatgtgatcgtgtcgattaccagctctttcagccctctgctcatgaacgagcatgtgaagggacctactcatatcgctgctatgggaaccgataccaaggggaagcaagagcttgatcctgctttggtggctagggctagaatcttcactgatgaggtggcacagtccgtgtctatcggagaatgtcaacacgctattgctgctggactcatccgtgaggatcaagttggagaacttggagctgttgtggctggtgatgatcctggaagaggtgatgctgaggtgaccattttcgatggaactggtgttggactccaggatcttgctgttgctcaagctgttgtcgagctggctaagcacaagggtgttgcacaagaggtcgagatctga

SEQ ID NO: 966 - DNA, 1191 bp, Artificial Sequence
  Arabidopsis codon-optimized sequence of AsGAT enzyme from Paracoccus denitrificans DSM 413 for expression in plant cytosol
atgacctctcagaaccctattttcatccctgggcctacgaacatccctgaagagatgagaaaggctgtggacatgcctaccatcgatcacagatctccagtgttcggaaggatgcttcatcctgctcttgagggcgttaagaaggtgctcaagactactcaggctcaggtgttcttgttcccttctactggaactggtggatgggagactgcgattactaacacactcagccctggtgataaggtgctcgctgctagaaacggaatgttctctcaccgttggatcgacatgtgccagagacatggactcgatgtgaccttcgttgaaactccttggggagaaggtgtgcctgctgatagattcgaagagatcctcaccgctgataagggacacgagatcagagttgtgctcgctactcataacgagactgctaccggtgtgaagtccgatattgctgctgttagaagggctctcgatgctgctaaacacccggctttgcttttcgtggacggtgtctcttctatcggctctatggatttcaggatggacgagtggggagtcgatatcgctgttaccggaagccaaaagggattcatgcttcctccaggactcgctatcgttggattctctccaaaggctatggaagctgtcgagacagctagactccctaggaccttcttcgatatccgtgatatggctaccgggtacgctaggaatggatacccttatactcctccggtgggactcatcaacggacttaatgcttcttgcgagcgtatccttgctgagggacttgagaacgtgttcgctagacatcacaggatcgctagcggagttagagctgctgttgatgcttggggacttaagctctgcgctgttagacctgagctgtactctgattccgtgtctgctatcagagtgcctgagggtttcgatgctaacctcatcgtttctcacgccctcgagacttacgatatggctttcggaactggactcggacaggttgcaggtaaggttttcagaatcggacacctcggatctctgaccgatgctatggctctttctggaatcgctactgccgagatggttatggctgatcttggacttcctatccagctcggatctggtgttgctgctgctcaagaacactacagacagactactgctgctgcccaaaagaaggctgcttga

SEQ ID NO: 967 - protein, 251 aa, Artificial Sequence
  Conserved amino acid sequence of the IsRed enzymes
  misc_feature (2)..(2): Xaa can be any naturally occurring amino acid
  misc_feature (4)..(4): Xaa can be any naturally occurring amino acid
  misc_feature (6)..(9): Xaa can be any naturally occurring amino acid
  misc_feature (10)..(11): Xaa can be any naturally occurring amino acid or a gap
  misc_feature (12)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (20)..(21): Xaa can be any naturally occurring amino acid
  misc_feature (23)..(23): Xaa can be any naturally occurring amino acid
  misc_feature (25)..(27): Xaa can be any naturally occurring amino acid
  misc_feature (28)..(28): Xaa can be any naturally occurring amino acid or a gap
  misc_feature (29)..(31): Xaa can be any naturally occurring amino acid
  misc_feature (36)..(38): Xaa can be any naturally occurring amino acid
  misc_feature (41)..(44): Xaa can be any naturally occurring amino acid
  misc_feature (46)..(53): Xaa can be any naturally occurring amino acid
  misc_feature (55)..(56): Xaa can be any naturally occurring amino acid
  misc_feature (59)..(59): Xaa can be any naturally occurring amino acid
  misc_feature (64)..(67): Xaa can be any naturally occurring amino acid
  misc_feature (69)..(71): Xaa can be any naturally occurring amino acid
  misc_feature (73)..(80): Xaa can be any naturally occurring amino acid
  misc_feature (82)..(83): Xaa can be any naturally occurring amino acid
  misc_feature (87)..(87): Xaa can be any naturally occurring amino acid
  misc_feature (89)..(91): Xaa can be any naturally occurring amino acid
  misc_feature (93)..(107): Xaa can be any naturally occurring amino acid
  misc_feature (110)..(137): Xaa can be any naturally occurring amino acid
  misc_feature (138)..(139): Xaa can be any naturally occurring amino acid or a gap
  misc_feature (140)..(148): Xaa can be any naturally occurring amino acid
  misc_feature (150)..(164): Xaa can be any naturally occurring amino acid
  misc_feature (166)..(168): Xaa can be any naturally occurring amino acid
  misc_feature (174)..(175): Xaa can be any naturally occurring amino acid
  misc_feature (177)..(177): Xaa can be any naturally occurring amino acid
  misc_feature (179)..(191): Xaa can be any naturally occurring amino acid
  misc_feature (193)..(195): Xaa can be any naturally occurring amino acid
  misc_feature (197)..(200): Xaa can be any naturally occurring amino acid
  misc_feature (203)..(203): Xaa can be any naturally occurring amino acid
  misc_feature (205)..(220): Xaa can be any naturally occurring amino acid
  misc_feature (222)..(230): Xaa can be any naturally occurring amino acid
  misc_feature (232)..(233): Xaa can be any naturally occurring amino acid
  misc_feature (234)..(234): Xaa can be any naturally occurring amino acid or a gap
  misc_feature (235)..(237): Xaa can be any naturally occurring amino acid
  misc_feature (239)..(240): Xaa can be any naturally occurring amino acid
  misc_feature (243)..(243): Xaa can be any naturally occurring amino acid
  misc_feature (245)..(247): Xaa can be any naturally occurring amino acid
  misc_feature (250)..(250): Xaa can be any naturally occurring amino acid
GXKXGXXXXXXXXGXKXGGXXPXNXXXXXXXNHQSXXXLFXXXXGXXXXXXXXNXXTAXRTAAXXXXSXXXLXXXXXXXXGXXGAGXQXXXQXXXXXXXXXXXXXXXWNXXXXXXXXXXXXXXXXXXXXXXXXXXXXXXXXXXXXXXXSXXXXXXXXXXXXXXXHXXXMGTDTXXKXEXXXXXXXXXXXXXDXXXQXXXXGEXQXXXXXXXXXXXXXXXXGXXXXXXXXXRXXXXXXTXXDGXGXXXQDXA

SEQ ID NO: 968 - protein, 270 aa, Artificial Sequence
  Conserved amino acid sequence of the AsGAT enzymes
  misc_feature (2)..(13): Xaa can be any naturally occurring amino acid
  misc_feature (15)..(16): Xaa can be any naturally occurring amino acid
  misc_feature (18)..(18): Xaa can be any naturally occurring amino acid
  misc_feature (19)..(20): Xaa can be any naturally occurring amino acid or a gap
  misc_feature (21)..(29): Xaa can be any naturally occurring amino acid
  misc_feature (33)..(33): Xaa can be any naturally occurring amino acid
  misc_feature (37)..(37): Xaa can be any naturally occurring amino acid
  misc_feature (39)..(58): Xaa can be any naturally occurring amino acid
  misc_feature (60)..(60): Xaa can be any naturally occurring amino acid
  misc_feature (64)..(68): Xaa can be any naturally occurring amino acid
  misc_feature (70)..(73): Xaa can be any naturally occurring amino acid
  misc_feature (75)..(76): Xaa can be any naturally occurring amino acid
  misc_feature (78)..(81): Xaa can be any naturally occurring amino acid
  misc_feature (87)..(87): Xaa can be any naturally occurring amino acid
  misc_feature (89)..(91): Xaa can be any naturally occurring amino acid
  misc_feature (93)..(123): Xaa can be any naturally occurring amino acid
  misc_feature (124)..(127): Xaa can be any naturally occurring amino acid or a gap
  misc_feature (128)..(130): Xaa can be any naturally occurring amino acid
  misc_feature (132)..(132): Xaa can be any naturally occurring amino acid
  misc_feature (135)..(140): Xaa can be any naturally occurring amino acid
  misc_feature (142)..(150): Xaa can be any naturally occurring amino acid
  misc_feature (151)..(151): Xaa can be any naturally occurring amino acid or a gap
  misc_feature (152)..(152): Xaa can be any naturally occurring amino acid
  misc_feature (154)..(160): Xaa can be any naturally occurring amino acid
  misc_feature (163)..(165): Xaa can be any naturally occurring amino acid
  misc_feature (167)..(169): Xaa can be any naturally occurring amino acid
  misc_feature (171)..(175): Xaa can be any naturally occurring amino acid
  misc_feature (177)..(181): Xaa can be any naturally occurring amino acid
  misc_feature (183)..(188): Xaa can be any naturally occurring amino acid
  misc_feature (190)..(197): Xaa can be any naturally occurring amino acid
  misc_feature (199)..(218): Xaa can be any naturally occurring amino acid
  misc_feature (220)..(220): Xaa can be any naturally occurring amino acid
  misc_feature (222)..(229): Xaa can be any naturally occurring amino acid
  misc_feature (232)..(232): Xaa can be any naturally occurring amino acid
  misc_feature (235)..(235): Xaa can be any naturally occurring amino acid
  misc_feature (237)..(250): Xaa can be any naturally occurring amino acid
  misc_feature (252)..(263): Xaa can be any naturally occurring amino acid
  misc_feature (265)..(265): Xaa can be any naturally occurring amino acid
  misc_feature (267)..(268): Xaa can be any naturally occurring amino acid
WXXXXXXXXXXXXLXXDXXXXXXXXXXXXNETXTGVXSXXXXXXXXXXXXXXXXXXXXDXVSSXXXXXFXXXXWXXDXXXXGSQKGXMXXXGXXXXXXXXXXXXXXXXXXXXXXXXXXXXXXXXXXXXXXPXTPXXXXXXGXXXXXXXXXXXEXXXXXXXRHXXXAXXXRXXXXXWXXXXXAXXXXXXSXXXXXXXXPXXXXXXXXXXXXXXXXXXXXGXGXXXXXXXXFRXGHXGXXXXXXXXXXXXXXEXXXXXXXXXXXXGXGXXAA

SEQ ID NO: 969 - DNA, 963 bp, Artificial Sequence
  IsRed enzyme from Paracoccus denitrificans DSM 413
atgctcgtcgtcgccgaaaaggaaatcgcgggtctgatgacccccgaggcggccttcgaggccatcgaggcggtcttcgcctcgatggcccggcgcaaggcatacaattttcccgtggtgcgcgaggccatcggccatgaggacgcgctctacggcttcaagggcggcttcgacgcctcggcgctggtgctggggctgaaggccggcggctactggcccaacaaccagaagcacaacctgatcaaccaccagtccaccgtgttcctgttcgacccggataccggccgggtctcggcggcggtaggcggcaacctgctgacggcgctgcgcaccgcggcggcctcggcggtgtcgatcaagtatctggcgcccaagggcgccaaggtgctgggcatgatcggcgccggccaccagtccgcgttccagatgcgggcggcggccaatgtgcatcggttcgaaaaggtcatcggctggaacccgcatcccgagatgctgtcgcgccttgccgataccgcggccgagctgggcctgcccttcgaggcggtcgaactggaccggcttggggccgaggccgacgtgatcgtctcgatcacctcgtccttctcgcctctgctgatgaacgagcatgtcaagggcccgacgcatatcgcggccatgggcaccgacaccaagggcaagcaagagctggatccggcgctggtcgcgcgcgcacggatcttcaccgacgaggtcgcgcagtcggtcagcatcggcgaatgccagcacgccatcgcggcgggtctgatccgcgaggatcaggtcggcgagcttggcgcggtggtcgcgggcgacgacccgggccgcggggatgccgaggtcacgatcttcgacggcaccggcgtcgggttgcaggacctggcggtcgcgcaagcggtcgtcgaactcgccaaacacaagggggtggcgcaagaggtcgagatctga

SEQ ID NO: 970 - DNA, 1164 bp, Artificial Sequence
  BHAA enzyme from Paracoccus denitrificans DSM 413
atgaacgcgaaaacggatttctccggctacgaggtcggctatgacatccccgccctgcccggcatggacgagagcgagatccagacgccttgcctgatcctcgacctggacgcgctggagcgcaacatcaggaagatgggcgactacgccaaggcccacggcatgcgccaccgcagccacggcaagatgcacaagtcggtcgacgtgcagaagctgcaggagtcgctgggcggctcggtcggcgtctgctgccagaaggtcagcgaggccgaggcctttgcccgcggcggcatcaaggacgtgctggtcaccaacgaggtgcgcgagccggccaagatcgaccgcctggcccggctgcccaagaccggcgccacggtgacggtctgcgtcgacgacgtgcagaacatcgccgacctgtcggccgccgcgcagaagcacggcaccgagctgggcatcttcgtcgagatcgattgcggcgccggccgctgcggcgtgaccaccaaggaagccgtggtcgagatcgccaaggccgccgcggctgccccgaacctgaccttcaagggcatccaggcctatcagggcgcgatgcagcacatggacagcttcgaggaccgcaaggccaagctggacgccgccattgcccaggtgaaagaggccgtggacgcgctggaggccgagggcctggcccccgaattcgtctcgggcggcggcacgggttcctattatttcgaaagcaattctggtatttacaacgaattgcaatgcggctcctatgccttcatggatgccgattacggccgcatccacgatgccgagggcaagcgcatcgaccagggcgaatgggaaaacgcgctgttcatcctgacctcggtcatgtcgcatgccaagccgcacctggcggtggtcgatgccggcctcaaggcacagtcggtcgatagcggcctgcccttcgtctatggccgcgacgatgtgaaatacatcaagtgcagcgacgagcatggcgtggtcgaggacaaggacggcgtgctcaaggtcaacgacaagctgcggctggtgccgggccattgcgacccgacctgcaacgtccacgactggtatgtcggcgtgcggaacggcaaggtcgagacggtctggccggtctcggcgcgcggaaagggctactga

SEQ ID NO: 971 - protein, 387 aa, Artificial Sequence; identical to SEQ ID NO: 953
  BHAA enzyme from Paracoccus denitrificans DSM 413

SEQ ID NO: 972 - DNA, 948 bp, Artificial Sequence; identical to SEQ ID NO: 964
  BHAD enzyme from Paracoccus denitrificans DSM 413

SEQ ID NO: 973 - protein, 315 aa, Artificial Sequence; identical to SEQ ID NO: 954
  BHAD enzyme from Paracoccus denitrificans DSM 413

SEQ ID NO: 974 - DNA, 1191 bp, Artificial Sequence
  AsGAT enzyme from Paracoccus denitrificans DSM 413
atgaccagccagaacccgatcttcattcccggcccgaccaacatccccgaggagatgcgcaaggccgtcgacatgcccaccatcgaccaccgctcgccggtgttcgggcgtatgctgcacccggcgctcgagggcgtgaagaaagtcctcaagaccacgcaggcgcaggtcttcctgttcccctcgaccggcaccggcggctgggaaacggcgatcaccaacacgctgtcgcccggcgacaaggtgctggcagcccgtaacggcatgttcagccatcgctggatcgacatgtgccagcgccacggccttgacgtgaccttcgtcgagaccccctggggcgagggcgtcccggccgaccgcttcgaagagatcctgaccgccgacaagggccacgagatccgcgtcgtcctggccacgcataacgagaccgcgaccggggtcaaatcggacatcgccgccgtccgccgcgcgctggacgccgcgaaacacccggcgctgctgttcgtggacggggtctcctccatcggttcgatggatttccgcatggacgaatggggcgtcgacatcgccgtcaccgggtcgcaaaagggcttcatgttgccgccgggcctggccatcgtcggcttctcgcccaaggcgatggaggcggtcgagaccgcgcgcctgccgcgcaccttcttcgacatccgcgacatggcgaccggctatgcccgcaacggctatccctatacgccgccggtcgggctgatcaacggcctgaacgccagctgcgagcgcatcctggccgaggggctggagaatgtctttgcccgccaccaccgcatcgccagcggcgtgcgcgccgcggtcgatgcctgggggctgaagctctgcgccgtccgccccgagctttactcggacagcgtcagcgccatccgcgtgcccgagggcttcgacgccaacctgatcgtcagccacgcgctggagacctatgacatggccttcggcaccggcctgggccaggtcgcgggcaaggtgttccgcatcggccacctgggcagcctgaccgacgccatggcgctgtccggcatcgccaccgccgagatggtgatggccgatctgggcctgccgatccagctgggctcgggcgtcgccgccgcgcaggaacattaccgccagaccactgccgccgcgcagaagaaagccgcctga

SEQ ID NO: 975 - DNA, 840 bp, Artificial Sequence
  BHA-regulatory protein from Paracoccus denitrificans DSM 413
atgtcggttcaaatccgcaaaaggggccgtccgaggggacgtgccggcggccttggcgccgaggattcgggcggcatccgggcgctggaccgggcgctggacatccttgacctgatcgcggtctccagcgggttgaccctgaccgagatcgcgcagcggctggacatggcgccttcgaccgtgcaccgggtgctggtgacgctggcggcgcgcggggtggcggaaagcgacagccagacgcaggcatggcatgtcgggccgacggcgttccggcacggctcggccttcatgcgccgctcgggcctggtcgagcgggcgcggccgcttctgcgccggctgatggaggtgacgggcgagacggcgaacctgggcatcctgaacggcgatgcggtcctgttcctaagccaggccgagacgcatgagacgatccgcgccttctttccgcccggcacgcgctcggcgctgcatgcctcggggatcggcaaggcgttgctggcccatgcccggcccctggacctgaagcggatgctgcgcgagatgcggctggagcggttcaccgacatgaccctgaccgatcccgcagcactggtcgaggatctcgtgcagatccgcgcccgcggctatgcgctggacaacgaggagcgcacgcccggcatgcgctgcatcgccgcgccgatcttcgaccttgccggcgaggcggcggcggggatctcggtttcggggccgacattgcgcatgtcggatgcccggctttccgccatgtccgatgcggtgatcgaggccgcgcgggagctgtccttcggcatggcgccgcgcaaggatgccggcgaaagagcctga

SEQ ID NO: 976 - DNA, 31 bp, Artificial Sequence
  Primer for cloning of ISRed from Paracoccus denitrificans DSM 413 into pET16b, fwd
gacgcctcatatgctcgtcgtcgccgaaaag

SEQ ID NO: 977 - DNA, 31 bp, Artificial Sequence
  Primer for cloning of ISRed from Paracoccus denitrificans DSM 413 into pET16b, rev
gccactcctcgagtcagatctcgacctcttg

SEQ ID NO: 978 - DNA, 31 bp, Artificial Sequence
  Primer for cloning of BHAA from Paracoccus denitrificans DSM 413 into pET16b, fwd
gacgccgcatatgaacgcgaaaacggatttc

SEQ ID NO: 979 - DNA, 29 bp, Artificial Sequence
  Primer for cloning of BHAA from Paracoccus denitrificans DSM 413 into pET16b, rev
gacacctggatcctcagtagccctttccg

SEQ ID NO: 980 - DNA, 31 bp, Artificial Sequence
  Primer for cloning of BHAD from Paracoccus denitrificans DSM 413 into pET16b, fwd
gacgctgcatatgtatatcccgacctatgag

SEQ ID NO: 981 - DNA, 32 bp, Artificial Sequence
  Primer for cloning of BHAD from Paracoccus denitrificans DSM 413 into pET16b, rev
gacactcggatcctcagttccacggcagcttg

SEQ ID NO: 982 - DNA, 27 bp, Artificial Sequence
  Primer for cloning of AsGAT from Paracoccus denitrificans DSM 413 into pET16b, fwd
gccactacatatgaccagccagaaccc

SEQ ID NO: 983 - DNA, 32 bp, Artificial Sequence
  Primer for cloning of AsGAT from Paracoccus denitrificans DSM 413 into pET16b, rev
gccactcggatcctcaggcggctttcttctgc

SEQ ID NO: 984 - DNA, 26 bp, Artificial Sequence
  Primer for cloning of BHAR from Paracoccus denitrificans DSM 413 into pET16b, fwd
gccacatcatatgtcggttcaaatcc

SEQ ID NO: 985 - DNA, 34 bp, Artificial Sequence
  Primer for cloning of BHAR from Paracoccus denitrificans DSM 413 into pET16b, rev
gtcactcggatcctcaggctctttcgccggcatc

SEQ ID NO: 986 - DNA, 11619 bp, Artificial Sequence
  multigene T-DNA construct pMR228N for BHAP implementation in plant peroxisomes.
  misc_feature (255)..(954): Promoter sequence
  misc_feature (2169)..(2882): Terminator sequence
  misc_feature (2907)..(3792): Promoter sequence
  misc_feature (4773)..(5027): Terminator sequence
  misc_feature (5068)..(5858): Promoter sequence
  misc_feature (6969)..(7172): Terminator sequence
  misc_feature (7197)..(7975): Promoter sequence
  misc_feature (9275)..(9556): Terminator sequence
  misc_feature (9581)..(11438): kanamycin resistance cassette
ctgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactggggtggatgcagtgggccccactctgtggaagacaatgccgaattcggatccggaggcttaagtgggccgtaagtgcaattgcgttgtgctccaaaaggaacggtgccgtgggttcctcttgttcatcagaaatatattaattagccgtaaaacctgaaaattcacaagcatttggattgttttctaatttaatatccattatgtgactaaaagttctagtgatcgtacatactacatagaaaataataacacaaaatactagtttacatttcccaattaaaaaccattttgaatgaactctgtctgatttaattatacttttaaaatgtgggatgaattcaaagattatacttatattcttattatttaagattatcaagtggaaaaataaaaatatgaatgtgttaatataaggtaatagaaatttaatcatttttttaatctatatgtaaaaagtatttaaccgatatctacaatttgacgcctcccaattgaaaggagccaaaagcaaccgatcaagtgcagagtgaatgtgtatggctactggtcctacccttacatgagaaagataagattatggagttttctgccacgtgatcttatcctagtggtccaaatcgataagggtgtcaacacctttccttaatcctgtggcaattaacgacgttatcatgaattatggcccctttgatcattagggctagttgcctctagcggttcccactatataaagatgacaaaaccaacagacaaacaagtaagtaagagaaaaaccaaaagaagaagagaaacaacaagaagaagtaatgcatcaccatcaccaccaccgattagctgttctctcaggtcatttaaacgctaagaccgacttttctggatacgaggtgggatacgatatccctgctttgcctggaatggacgagtctgagatccagacaccttgccttatcctcgatcttgatgctctcgagcgtaacatccgtaagatgggagattacgctaaggctcacggaatgaggcatcgttctcatgggaagatgcacaagtctgtggatgtgcagaagctccaagagtctctcggaggatctgttggagtttgctgccagaaagtttctgaggctgaagctttcgctcgtggcggaatcaaggatgttcttgtgactaacgaggtgagagagccggctaagatcgatagacttgctagactccctaagaccggtgctactgttactgtttgcgttgacgacgtgcagaatatcgctgatctttctgctgctgctcagaagcacggaactgagcttggaatcttcgttgagatcgattgcggagctggaagatgcggagttactaccaaagaggctgttgtcgagatcgctaaggcagctgctgcagctcctaaccttactttcaagggaatccaggcttaccagggtgctatgcagcacatggattctttcgaggaccgtaaggctaagctcgatgctgctatcgctcaagtgaaagaagctgtggacgctcttgaagctgaaggacttgctcctgagttcgtttctggtggtggaaccggatcttactacttcgagagcaacagcgggatctacaacgagcttcagtgtgggtcttacgctttcatggatgctgactacggaaggatccatgacgctgagggaaagcgtattgatcagggcgaatgggagaacgcccttttcatcctcacctctgtgatgtctcatgctaagcctcatctcgctgttgtggatgctggacttaaggctcagtctgttgattctggactcccgttcgtgtacggaagggatgatgtgaagtacatcaagtgctctgacgagcacggtgtggtggaagataaggatggtgttctcaaggtgaacgacaagctcaggcttgttcctggacattgcgatcctacttgcaacgtgcacgattggtacgtgggagtgagaaacggaaaggttgagactgtttggcctgtgtctgctcgtggaaagggatactgagcttgtcctgctttaatgagatatgcgagaagcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggaccgctgcaagaattcaagcttggagcgggcttgattcgatattaatatgggatggtgtacaacgggtgaaattttagaattgactggtttgagttgataataatttgcgatagaactaggagtgaaatcctagaatgacaatcaagttattattatacaattaaatactaccacaggtgaaatcctagaattgacgggtttgattcgatattaatatgggatggtgtactacgggtgaaatccgagaaacaacaatcaaaatacaattatacaatattaaacatttaacaaaataaacaaatacaacttaaaactttaaaatttgagttataaaattttgtctcgcggtgaattatacatttaaatcaaacaatagcagaaatttattaagtcatcctaagaaatattcaattattttttatttaatgaaaatatagacccgcggtataccgcggattaatatttagtgctattgataaatttatctcaacgttcagctttgacattgtgaaatgcattatgagtcatgactctgtttatagatattcctgttatagtatttattaaccgaagtaatgtaaaccaaattttaaaaatacatacaagataaataaaaggtccaaaacattatatttacggtcatgcatctgatttcttttcttccaaaaggaaggagccaaagcaaccgatcaagtggagactagtaaaccatacacaatcactcatttcctcacaaaagaaagataagataagggtgtcaacacctttccttaatcatgtggtagtgaacgagttatcatgaatcccggaccctttgatcattagggctttttgcctcttacggttctcactatataaagatgacaaaaccaatagaaaaacaattaagcaaaagaagaagaagaagaagtaatgcatcaccatcaccaccactacatccctacctacgaggatatgcttgctgctcacgagagaatcaagcctcacatcagaagaaccccgatcaggacctctgattacctcaacgaacttaccggggctcagctgttcttcaagtgcgaaaatttccaagagcctggggccttcaaggtgagaggtgctactaatgctgtgttcggactcgatgatgctcaggctgctaagggtgttgctactcactcttctggaaaccacgctagctgcctttcttacgctgctatgcttagagggatcccatgcaacgttgtgatgcctagaactgctcctcaggctaagaaggataccgttagaagatacggcggagtgatcacagagtgcgagccttctacttctagccgtgaagagactttcgctaaggtgcaagctgagactggtggtgacttcgtgcatccttacaacgatcctagagtgatcgctggacagggaacttgcgctaaagagcttgttgagcaggttgacggacttgatgctgttgttgctcctattggaggcggaggaatgatctctggaacttgccttactctctctaccctcgctcctgagacaagagttattgctgctgaacctgagcaggctgatgacgcttacagatctttcaaggccggctacattatcgctgacgatgctcctaagactgtggctgatggacttctcgttcctctcaaggatctcacttggcacttcgtgaagaaccacgtgagcgagatctacaccgcttcagatgctgagatcgtggacgctatgaagctcatctggaagcacctcaggatcgtgatggaaccttcttctgctgttcctctcgctaccatccttaagaaccctgaagctttcgctggaaagcgtgttggagttatcgtgaccggtggaaacgttgaccttgataagctcccgtggaacagcaagctttgagcttgtcaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgctactagaattcgagctcggaggttagaattcttttgataggtttacttccattagtctgaaatggaatcttatttataagtctgcctgaaaaatcttaacaattgatattaataaaacggaaagagtaatgaatatttttaagagcatctcgaatctatctctatttttatttatatactctatttttgtatttatttaactctaactcatctctattttcatttgtaaaatagaaatttctaattttttttctaaagcaaaaaatagagatttttattttttctcttatttattttttctaacgaatttttgaggaaccattgaagttaaaatataaatctctattatattttttcctctatattcagaaagaaaataatagaaacaaatattggagatggttaaagcttttttttttgtccggataaatatcatacaatatatttatgtaaatatcaaatttaaataattttgttataactattttttaatgcgaccttatttccaaagaaagtgttaagccaaattaaatcatacatggtaaataagaggtccaaaagaccaaaagcattaaatttaaggtaatgcgtctggtttcttttctcccaaacgaaaggagccaaaagcaaccgatcaagtgcagaccagtaaccgcacattcacttcatttcccccacaagagaaaagataagataatggagttttctgccacgtggccttatcctagtggtgcgtaccgataagggtgtcaacacctttccttaatcctgtggcagtaaacgacgttatcatgaatcatggaccctttgatcatgagggcttttcgcctttagggggttctcattatataaagatgacaacaccagtaggaaaacaagtcagtaagtaaacgagcaaaagaagaagagaaacaacaagaagtagtaatgtacccttacgatgtgcctgattacgctctcgtggttgccgagaaagaaatcgctggacttatgactcctgaggctgctttcgaagctatcgaggctgttttcgcttctatggctaggcgtaaggcttacaacttccctgttgttcgtgaggctatcggacatgaggatgcactctatggattcaaaggcgggttcgatgcttctgctcttgttcttggacttaaggccggtggatactggccgaacaaccagaagcacaacctcatcaaccaccagtctaccgtgttcctcttcgatcctgataccggaagagtgtctgctgctgttggaggaaaccttctcactgctcttagaaccgctgctgctagcgctgtgtctatcaagtatcttgctccgaagggtgctaaggtgctcggaatgattggagctggacatcagtctgctttccagatgagagctgctgcaaacgtgcacaggttcgagaaggttatcggatggaatccgcatcctgagatgctttctagactcgctgatacggctgctgagcttggacttccatttgaggctgttgagttggatagactcggagctgaggctgatgtgatcgtgtcgattaccagctctttcagccctctgctcatgaacgagcatgtgaagggacctactcatatcgctgctatgggaaccgataccaaggggaagcaagagcttgatcctgctttggtggctagggctagaatcttcactgatgaggtggcacagtccgtgtctatcggagaatgtcaacacgctattgctgctggactcatccgtgaggatcaagttggagaacttggagctgttgtggctggtgatgatcctggaagaggtgatgctgaggtgaccattttcgatggaactggtgttggactccaggatcttgctgttgctcaagctgttgtcgagctggctaagcacaagggtgttgcacaagaggtcgagatctctaagctctgagcttctctagctagagtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcgctttacgaattcccatggggagtttccggttgaaatgggtttggtgaatatccggttcagttatatggtggccgttggaattggcttattagttgtggccgttgttgaagccgttggtattggtaagggagaagcagacttgtggctatgagtctatgaccatgactcgtgattatggagctgtcttatgaccctgaccatcaccttgatctggtggattccaatgttttcttcttcttctaataaaatattatggtcaatacaggtgctaattaagatggtaataatttcttatgtttctgtggtaaagtttgattcaattccgtagttttagataatcttatttccatacataaattttatagttttatctactttgttcttatgttttatctctagccaagagttattattattatcagaagaagaaaaaaaaaagaagcatatatacaaaaggtttaataaaatgtattatacaaggcaattatccaaattttttttgttttggtttacattgatgctctcaggatttcataaggatagagagatctattcgtatacgtgtcacgtcatgagtgggtgtttcgccaatccatgaaacgcacctagatatctaaaacacatatcaattgcgaatctgcgaagtgcgagccattaaccacgtaagcaaacaaacaatctaaaccccaaaaaaaatctatgactagccaatagcaacctcagagattgatatttcaagataagacagtatttagatttctgtattatatatagcgaaaatcgcatcaataccaaaccacctactgtatttttacaacaattaccaacaacaacaaacaacaaacaacattacaattactatttacaattacaatgtacccttacgatgtgcctgactacgctacctctcagaaccctattttcatccctgggcctacgaacatccctgaagagatgagaaaggctgtggacatgcctaccatcgatcacagatctccagtgttcggaaggatgcttcatcctgctcttgagggcgttaagaaggtgctcaagactactcaggctcaggtgttcttgttcccttctactggaactggtggatgggagactgcgattactaacacactcagccctggtgataaggtgctcgctgctagaaacggaatgttctctcaccgttggatcgacatgtgccagagacatggactcgatgtgaccttcgttgaaactccttggggagaaggtgtgcctgctgatagattcgaagagatcctcaccgctgataagggacacgagatcagagttgtgctcgctactcataacgagactgctaccggtgtgaagtccgatattgctgctgttagaagggctctcgatgctgctaaacacccggctttgcttttcgtggacggtgtctcttctatcggctctatggatttcaggatggacgagtggggagtcgatatcgctgttaccggaagccaaaagggattcatgcttcctccaggactcgctatcgttggattctctccaaaggctatggaagctgtcgagacagctagactccctaggaccttcttcgatatccgtgatatggctaccgggtacgctaggaatggatacccttatactcctccggtgggactcatcaacggacttaatgcttcttgcgagcgtatccttgctgagggacttgagaacgtgttcgctagacatcacaggatcgctagcggagttagagctgctgttgatgcttggggacttaagctctgcgctgttagacctgagctgtactctgattccgtgtctgctatcagagtgcctgagggtttcgatgctaacctcatcgtttctcacgccctcgagacttacgatatggctttcggaactggactcggacaggttgcaggtaaggttttcagaatcggacacctcggatctctgaccgatgctatggctctttctggaatcgctactgccgagatggttatggctgatcttggacttcctatccagctcggatctggtgttgctgctgctcaagaacactacagacagactactgctgctgcccaaaagaaggctgcttctaagctttgagcttatatgtcaacagtgagaaactgttcgcattttccgttttgcttctttctttctattcaatgtatgttgttggattccagttgaatttattatgagaactaataataatagtaataatcatttgtttctttactaatttgcattttcacatatgatttctggtgcatatcataattttcattccaccaatattaatttccccattcaagttacttatgaaatagaaatcctcttctccgactactttatttgtccgaaagtcttgtggctgctatataacgctcagagaattcgcatgcggagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactcgacttttacaacaattaccaacaacaacaaacaacaaacaacattacaattactatttacaattatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaaggccccaggggctagtatctacgacacaccgagcggcgaactaataacgttcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagccgcttgtgttgtcttcgaggatgcacatgtgaccgagggacacgaagtggtttaaactatcagtgtttgacaggatatattggcgggtaaacctaagagaaaagagcgtttattagaataatcggatatttaaaagggcgtgaaaaggtttatccgttcgtccatttgtatgtgccaacca

What is claimed is:

1. A transgenic plant comprising: (a) a heterologous nucleic acid encoding an erythro-β-hydroxyaspartate aldolase enzyme, (b) a heterologous nucleic acid encoding an erythro-β-hydroxyaspartate dehydratase enzyme, (c) a heterologous nucleic acid encoding an iminosuccinate reductase enzyme comprising an amino acid sequence selected from SEQ ID NO: 1-299, or an amino acid sequence having at least 80% sequence identity to a sequence selected from SEQ ID NO: 1-299 and (d) a heterologous nucleic acid encoding an aspartate-glyoxylate transaminase enzyme comprising an amino acid sequence selected from SEQ ID NO: 300-599, or an amino acid sequence having at least 80% sequence identity to a sequence selected from SEQ ID NO:300-599.

2. The transgenic plant of claim 1, wherein (c) iminosuccinate reductase enzyme comprises an amino acid sequence selected from SEQ ID NO: 1, 7, 22, 25, 26, 39, 47, 58, 75, 123, 135, or 160, or an amino acid sequence having at least 80% sequence identity to a sequence selected from SEQ ID NO: 1, 7, 22, 25, 26, 39, 47, 58, 75, 123, 135, or 160.

3. The transgenic plant of claim 1, wherein the (c) iminosuccinate reductase enzyme comprises an amino acid sequence as set forth in SEQ ID NO: 135, or an amino acid sequence having at least 80% sequence identity to said sequence and the aspartate-glyoxylate transaminase enzyme comprises the amino acid sequence as set forth in SEQ ID NO:433, or an amino acid sequence having at least 80% sequence identity to said sequence.

4. The transgenic plant of claim 1, wherein (a) erythro-p-hydroxyaspartate aldolase enzyme is C-terminally fused to the peroxisomal targeting signal having the amino acid sequence of SEQ ID NO: 952 and enzymes (b)-(d) are N-terminally fused to the peroxisomal targeting signal having the amino acid sequence SKL.

5. The transgenic plant of claim 1, further comprising (e) a nucleic acid encoding a glycolate dehydrogenase enzyme and (f) a nucleic acid encoding a phosphoenolpyruvate carboxykinase enzyme, wherein said enzymes (a)-(f) are localized to the chloroplast and are N-terminally fused to the *Arabidopsis* Ferredoxin-2 chloroplastic target peptide having the amino acid sequence of SEQ ID NO: 917.

6. The transgenic plant of claim 1, wherein the plant is selected from *Helianthus annuus, Brassica napus, Camelina sativa, Oryza sativa, Hordeum vulgare, Triticum* spp., *Avena sativa, Solanum lycopersicum, Solanum tuberosum, Glycine max, Beta vulgaris, Nicotiana tabacum*, and *Arabidopsis thaliana*.

7. A method for the production of a transgenic plant according to claim 1 with altered photorespiration and improved $CO_2$ fixation, comprising introducing into a cell or tissue of said plant one or more heterologous nucleic acids encoding a polypeptide having the enzymatic activity of
  (a) erythro-β-hydroxyaspartate aldolase enzyme,
  (b) erythro-β-hydroxyaspartate dehydratase enzyme,
  (c) iminosuccinate reductase enzyme, and
  (d) aspartate-glyoxylate transaminase enzyme,
wherein the introduction of said nucleic acid(s) results in a de novo expression of the polypeptide having the enzymatic activity of
  (a) erythro-β-hydroxyaspartate aldolase enzyme,
  (b) erythro-β-hydroxyaspartate dehydrataseenzyme,
  (c) iminosuccinate reductase enzyme, and
  (d) aspartate-glyoxylate transaminase enzyme,
wherein the enzymatic activity of (c) iminosuccinate reductase enzyme comprises an amino acid sequence selected from SEQ ID NO: 1-299, or an amino acid sequence having at least 80% sequence identity to a sequence selected from SEQ ID NO: 1-299; and the enzymatic activity of (d) aspartate-glyoxylate transaminase enzyme comprises an amino acid sequence selected from SEQ ID NO: 300-599, or an amino acid sequence having at least 80% sequence identity to a sequence selected from SEQ ID NO: 300-599.

8. The method of claim 7, wherein the (c) iminosuccinate reductase enzyme comprises an amino acid sequence selected from SEQ ID NO: 1, 7, 22, 25, 26, 39, 47, 58, 75, 123, 135, or 160, or an amino acid sequence having at least 80% sequence identity to a sequence selected from SEQ ID NO: 1, 7, 22, 25, 26, 39, 47, 58, 75, 123, 135, or 160.

9. The method of claim 7, wherein the (c) iminosuccinate reductase enzyme comprises an amino acid sequence as set forth in SEQ ID NO: 135, or an amino acid sequence having at least 80% sequence identity to said sequence; and the (d) aspartate-glyoxylate transaminase enzyme comprises the amino acid sequence as set forth in SEQ ID NO: 433, or an amino acid sequence having at least 80% sequence identity to said sequence.

10. The method of claim 7, wherein the (a) erythro-β-hydroxyaspartate aldolase enzyme is C-terminally fused to the peroxisomal targeting signal having the amino acid sequence of SEQ ID NO: 952 and enzymes (b)-(d) are N-terminally fused to the peroxisomal targeting signal having the amino acid sequence SKL.

11. The method of claim 7, the transgenic plant further comprises (e) a nucleic acid encoding a glycolate dehydrogenase enzyme and (f) a nucleic acid encoding a phosphoenolpyruvate carboxykinase enzyme, wherein said enzymes (a)-(f) are localized to the chloroplast and are N-terminally fused to the Arabidopsis Ferredoxin-2 chloroplastic target peptide having the amino acid sequence of SEQ ID NO: 917.

* * * * *